(12) United States Patent
Chaudhary

(10) Patent No.: US 12,570,711 B2
(45) Date of Patent: *Mar. 10, 2026

(54) PLATFORMS FOR CO-STIMULATION, NOVEL CAR DESIGNS AND OTHER ENHANCEMENTS FOR ADOPTIVE CELLULAR THERAPY

(71) Applicant: Angeles Therapeutics, Inc., Toluca Lake, CA (US)

(72) Inventor: Preet M. Chaudhary, Toluca Lake, CA (US)

(73) Assignee: ANGELES THERAPEUTICS, INC., Toluca Lake, CA (US)

( * ) Notice: Subject to any disclaimer, the term of this patent is extended or adjusted under 35 U.S.C. 154(b) by 1096 days.

This patent is subject to a terminal disclaimer.

(21) Appl. No.: 16/651,907

(22) PCT Filed: Sep. 27, 2018

(86) PCT No.: PCT/US2018/053247
§ 371 (c)(1),
(2) Date: Mar. 27, 2020

(87) PCT Pub. No.: WO2019/067805
PCT Pub. Date: Apr. 4, 2019

(65) Prior Publication Data
US 2023/0140802 A1 May 4, 2023

Related U.S. Application Data

(60) Provisional application No. 62/564,249, filed on Sep. 27, 2017.

(51) Int. Cl.
| | |
|---|---|
| *C07K 14/725* | (2006.01) |
| *A61K 35/17* | (2025.01) |
| *A61K 40/11* | (2025.01) |
| *A61K 40/22* | (2025.01) |
| *A61K 40/31* | (2025.01) |
| *A61K 40/32* | (2025.01) |
| *A61K 40/41* | (2025.01) |
| *A61K 40/42* | (2025.01) |
| *A61K 40/46* | (2025.01) |
| *C07K 14/705* | (2006.01) |
| *C12N 5/0783* | (2010.01) |
| *A61K 40/50* | (2025.01) |

(52) U.S. Cl.
CPC .......... *C07K 14/7051* (2013.01); *A61K 40/11* (2025.01); *A61K 40/22* (2025.01); *A61K 40/31* (2025.01); *A61K 40/32* (2025.01); *A61K 40/418* (2025.01); *A61K 40/4211* (2025.01); *A61K 40/4221* (2025.01); *A61K 40/4269* (2025.01); *A61K 40/46* (2025.01); *C07K*

*14/705* (2013.01); *C12N 5/0636* (2013.01); *A61K 40/50* (2025.01); *A61K 2239/31* (2023.05); *A61K 2239/38* (2023.05); *A61K 2239/48* (2023.05); *C07K 2319/00* (2013.01); *C12N 2501/2302* (2013.01); *C12N 2501/515* (2013.01)

(58) Field of Classification Search
CPC .............. C07K 14/705; C07K 14/7051; C07K 2319/00; A61K 35/17; C12N 5/0636; C12N 2510/00
See application file for complete search history.

(56) References Cited

U.S. PATENT DOCUMENTS

| | | | |
|---|---|---|---|
| 4,708,871 | A | 11/1987 | Geysen |
| 5,199,942 | A | 4/1993 | Gillis |
| 5,350,674 | A | 9/1994 | Boenisch et al. |
| 5,585,089 | A | 12/1996 | Queen et al. |
| 5,585,362 | A | 12/1996 | Wilson et al. |
| 5,858,358 | A | 1/1999 | June et al. |
| 5,883,223 | A | 3/1999 | Gray |
| 6,326,193 | B1 | 12/2001 | Liu et al. |
| 6,352,694 | B1 | 3/2002 | June et al. |
| 6,534,055 | B1 | 3/2003 | June et al. |
| 6,692,964 | B1 | 2/2004 | June et al. |
| 6,703,199 | B1 | 3/2004 | Koide |
| 6,797,514 | B2 | 9/2004 | Berenson et al. |
| 6,867,041 | B2 | 3/2005 | Berenson et al. |
| 6,887,466 | B2 | 5/2005 | June et al. |
| 6,905,680 | B2 | 6/2005 | June et al. |
| 6,905,681 | B1 | 6/2005 | June et al. |
| 6,905,874 | B2 | 6/2005 | Berenson et al. |

(Continued)

FOREIGN PATENT DOCUMENTS

| | | | | |
|---|---|---|---|---|
| CN | 103987405 A | | 8/2014 | |
| CN | 105647871 A | * | 6/2016 | ........... C07K 14/705 |

(Continued)

OTHER PUBLICATIONS

Bloor et al., PNAS, 105(4):1279-1284 (Year: 2008).*

(Continued)

*Primary Examiner* — Hong Sang
(74) *Attorney, Agent, or Firm* — IPath, PLC; Steven J. Miller

(57) ABSTRACT

The disclosure provides compositions and method that promote adoptive cellular therapy. The disclosure provides polynucleotides, vectors, systems and cells comprising chimeric antigen receptors (CARs), synthetic immune receptors (SIRs), and the like in combination the specific activators of NFkB activity, thus improving cellular proliferation, expression and reduced apoptosis, which improves cell persistence in adoptive cell therapy.

21 Claims, 9 Drawing Sheets

Specification includes a Sequence Listing.

(56) References Cited

U.S. PATENT DOCUMENTS

| | | | |
|---|---|---|---|
| 7,067,318 B2 | 6/2006 | June et al. | |
| 7,144,575 B2 | 12/2006 | June et al. | |
| 7,172,869 B2 | 2/2007 | June et al. | |
| 7,175,843 B2 | 2/2007 | June et al. | |
| 7,232,566 B2 | 6/2007 | June et al. | |
| 7,741,465 B1 | 6/2010 | Eshhar et al. | |
| 2006/0121005 A1 | 6/2006 | Berenson et al. | |
| 2011/0033383 A1 | 2/2011 | Spencer et al. | |
| 2012/0093842 A1 | 4/2012 | Eshhar et al. | |
| 2012/0269814 A1 | 10/2012 | Wei et al. | |
| 2012/0321667 A1 | 12/2012 | Sentman | |
| 2014/0301990 A1 | 10/2014 | Gregory et al. | |
| 2016/0046700 A1 | 2/2016 | Foster et al. | |
| 2019/0055318 A1* | 2/2019 | Yankee | C12N 15/113 |

FOREIGN PATENT DOCUMENTS

| | | | | |
|---|---|---|---|---|
| JP | 2012-503019 A | 2/2012 | | |
| JP | 2013-525305 A | 6/2013 | | |
| WO | 01/29058 A1 | 4/2001 | | |
| WO | 01/96584 A2 | 12/2001 | | |
| WO | 2010/033949 A1 | 3/2010 | | |
| WO | 2011/130566 A2 | 10/2011 | | |
| WO | 2012/138475 A1 | 10/2012 | | |
| WO | 2013/059343 A1 | 4/2013 | | |
| WO | 2014/160030 A2 | 10/2014 | | |
| WO | 2015/107545 A1 | 7/2015 | | |
| WO | 2015/117229 A1 | 8/2015 | | |
| WO | WO-2015123527 A1 * | 8/2015 | | A61K 35/14 |
| WO | 2015/142675 A2 | 9/2015 | | |
| WO | 2016/120216 A1 | 8/2016 | | |
| WO | 2016/154143 A1 | 9/2016 | | |
| WO | 2016/187349 A1 | 11/2016 | | |
| WO | 2017/011804 A1 | 1/2017 | | |
| WO | WO-2017070608 A1 * | 4/2017 | | A61K 35/17 |
| WO | 2017/076308 A1 | 5/2017 | | |
| WO | 2017/172981 A2 | 10/2017 | | |
| WO | 2017/173403 A1 | 10/2017 | | |
| WO | WO-2017180989 A2 * | 10/2017 | | A61K 39/4611 |
| WO | 2018/053543 A1 | 3/2018 | | |
| WO | 2018/102795 A2 | 6/2018 | | |
| WO | 2019/232503 A1 | 12/2019 | | |
| WO | 2020/028444 A1 | 2/2020 | | |

OTHER PUBLICATIONS

Vinolo et al., JBC 2006, 281(10): 6334-6348.*
Palkowitsh et al., JBC, 2008, 283(1): 76-86.*
Almagro et. al., Frontiers in Immunology, 2018, 8: 1751, pp. 1-19.*
Herold et al. (Science Reports, 2017, 7(1):12276, pp. 1-17.*
Murphy et al., Journal of Immunological Methods, 2018, 463: 127-133.*
Baeuerle et al., "Synthetic TRuC receptors engaging the complete T cell receptor for potent anti-tumor response", Nature Communications, vol. 10, No. 1, May 7, 2019, pp. 1-12.
Nolan et al., "Bypassing Immunization: Optimized Design of "Designer T Cells" against Carcinoembryonic Antigen (CEA)-expressing Tumors, and Lack of Suppression by Soluble CEA 1", Dec. 1, 1999, vol. 5, No. 12, pp. 3928-3941.
Strobel, Andreas, Supplementary Partial European Search Report, Application No. 18863755.7, European Patent Office, Dec. 3, 2021.
Walseng et al., "A TCR-based Chimeric Antigen Receptor", Scientific Reports, Sep. 6, 2017, vol. 7, No. 1, pp. 1-10.
Li, Zheng, Office Action, China Intellectual Property Administration, Application No. 201880073056.6, Nov. 9, 2022.
Quan et al., "Study and progress of genetically modified T-Cells for cancer adoptive immunotherapy", China Journal of Cancer Biotherapy, Apr. 25, 2017, vol. 24, No. 4, pp. 436-441.
Amhad et al., "Targeted Regulation of PI3K/Akt/mTOR/NF-kB Signaling by Indole Compounds and their Derivatives: Mechanistic Details and Biological Implications for Cancer Therapy," Anticancer Agents in Medicinal Chemistry, vol. 13, No. 7, pp. 1002-1013, Sep. 2013.

Copenheaver, Blaine R.., International Search Report, U.S. Patent & Trademark Office, PCT/US2018/053247, Dec. 7, 2018.
Copenheaver, Blaine R., Written Opinion of the International Searching Authority, U.S. Patent & Trademark Office, PCT/US2018/053247, Dec. 7, 2018.
Wittmann-Regis, Agnes, International Preliminary Report on Patentability and Written Opinion, International Bureau of WIPO, PCT/US2018/053247, Apr. 9, 2020.
Torikai et al., "A foundation for universal T-cell based immunotherapy: T cells engineered to express a CD19-specific chimeric-antigen-receptor and eliminate expression of endogenous TCR," Blood, vol. 119, No. 24, pp. 5697-5705, 2012.
Bethane, M.T. et al., "Domain-swapped T cell receptors improve the safety of TCR gene therapy", eLife, Nov. 3, 2016, pp. 5, e19095.
Bunse, M. et al., "RNAi-mediated TCR Knockdown Prevents Autoimmunity in Mice Caused by Mixed TCR Dimers Following TCR Gene Transfer", Molecular Therapy, Jul. 22, 2014, vol. 22, Issue 11, pp. 1983-1991.
Eyquem, Justin, et al., "Targeting a CAR to the TRAC locus with CRISPR/Cas9 enhances tumour rejection", Nature, Mar. 2, 2017, 543(7643): 113-117.
Foster, A.E. et al., "Regulated expansion and survival of chimeric antigen receptor-modified T cells using small molecule-dependent inducible MyD88/CD40", Molecular Therapy, Jul. 8, 2017, vol. 25, No. 9, pp. 2176-2188.
Liu, X. et al., "CRISPR-Cas9-mediated multiplex gene editing in CAR-T cells", Cell Research, Dec. 2, 2016, vol. 27, No. 1, pp. 154-157.
Macleod, D.T. et al., "Integration of a CD19 Car into the TCR Alpha Chain Locus Streamlines Production of Allogeneic Gene-Edited CAR T Cells", Molecular Therapy, Apr. 5, 2017, vol. 25, No. 4, pp. 949-961.
Tan, Terence, First Written Opinion, Application No. 11202002321Y, Intellectual Property Office of Singapore, Oct. 27, 2021.
Themeli, M. et al., "Generation of tumor-targeted human T lymphocytes from induced pluripotent stem cells for cancer therapy", Nat. Biotechnol., Aug. 11, 2013, vol. 31, No. 10, pp. 928-933.
Voss, R.H. et al., "Coexpression of the T-cell receptor constant α domain triggers tumor reactivity of single-chain TCR-transduced human T cells", Blood, Jun. 24, 2010, vol. 115, No. 25, pp. 5154-5163.
Aggen et al., "Single-chain VaVj3 T-cell receptors function without mispairing with endogenous TCR chains," Gene Ther. 19(4):365-74, Apr. 2012.
Ali et al., "Half-genome Human Immunodeficiency Virus Type 1 Constructs for Rapid Production of Reporter Viruses", Journal of Virological Methods, vol. 110, pp. 137-142, 2003.
Altschul et al., "Basic Local Alignment Search Tool", Journal of Molecular Biology, vol. 215, pp. 403-410, 1990.
Altschul et al., "Gapped BLAST and PSI-BLAST: A New Generation of Protein Database Search Programs", Nucleic Acids Research, vol. 25, No. 17, pp. 3389-3402, 1997.
Aronovich et al., "The Sleeping Beauty transposon system: a non-viral vector for gene therapy", Human Molecular Genetics, vol. 20, Review, Issue 1, pp. R14-R20, 2011.
Bennett et al., "Fine-tuning of T-cell receptor avidity to increase HIV epitope variant recognition by cytotoxic T lymphocytes", Aids, vol. 24, No. 17, pp. 2619-2628, Nov. 13, 2010.
Bennett, et al., "Epitope-Dependent Avidity Thresholds for Cytotoxic T-Lymphocyte Clearance of Virus-Infected Cells", J. Virol., vol. 81, No. 10, pp. 4973-4980, May 2007.
Berger et al., "Adoptive transfer of virus-specific and tumor-specific T cell immunity", Curr. Opin. Immunol., vol. 21, No. 2, 15 pages, Apr. 2009.
Brown et al., "Bioactivity and Safety of IL13Ra2-Redirected Chimeric Antigen Receptor CD8+ T Cells in Patients with Recurrent Glioblastoma", Clinical Cancer Research, vol. 21, No. 18, pp. 4062-4072, Sep. 15, 2015.
Chinnery et al., "Bone Marrow Chimeras and c-fms Conditional Ablation (Mafia) Mice Reveal an Essential Role for Resident Myeloid Cells in Lipopolysaccharide/TLR4-Induced Corneal Inflammation", J. Immunol., vol. 182, No. 5, pp. 2738-2744, Mar. 1, 2009.

(56) References Cited

OTHER PUBLICATIONS

Chothia et al., "Canonical Structures for the Hypervariable Regions of Immunoglobulins", Journal of Molecular Biology, vol. 196, pp. 901-917, 1987.
Dao et al., "Targeting the Intracellular WT1 Oncogene Product with a Therapeutic Human Antibody", Sci. Transl. Med., vol. 5, No. 176, Mar. 13, 2013.
Ding et al., "Efficient Transposition of the piggyBac (PB) Transposon in Mammalian Cells and Mice", Cell, vol. 122, No. 3, pp. 473-483, Aug. 12, 2005.
Ding et al., "High-throughput Nuclear Delivery and Rapid Expression of DNA via Mechanical and Electrical Cell-Membrane Disruption", Nat. Biomed. Eng., vol. 1, 0039, 15 pages, 2017.
Geysen et al., "Use of peptide synthesis to probe viral antigens for epitopes to a resolution of a single amino acid", Proc. Natl. Acad. Sci., vol. 81, pp. 3998-4002, Jul. 1984.
Gopalakrishnan et al., "A Purine Scaffold HSP90 Inhibitor BIIB021 Has Selective Activity against KSHV-Associated Primary Effusion Lymphoma and Blocks vFLIP K13-Induced NF-kB", Clinical Cancer Res, vol. 19, No. 18, Sep. 15, 2013.
Grabundzija et al., "Comparative analysis of transposable element vector systems in human cells", Mol. Ther. vol. 18, No. 6 pp. 1200-1209, Jun. 2010.
Grabundzija et al., "Sleeping Beauty transposon-based system for cellular reprogramming and targeted gene insertion in induced pluripotent stem cells", Nucleic Acids Res., vol. 41, No. 3, pp. 1829-1847, Feb. 2013.
Green et al., "Molecular Cloning", A Laboratory Manual 4th ed., Cold Spring Harbor Laboratory Press, Cold Spring Harbor, 5 pages, 2012.
Hollinger et al., "Engineered antibody fragments and the rise of single domains", Nature Biotechnology, vol. 23, No. 9, pp. 1126-1136, Sep. 2005.
Homyak et al., "Introduction to Nanoscience and Nanotechnology", CRC Press, 169 pages, 2008.
Hopp et al., "Prediction of protein antigenic determinants from amino acid sequences" Proc. Nati. Acad. Sci., vol. 78, No. 6, pp. 3824-3828, Jun. 1981.
Huang et al., "Sleeping Beauty Transposon-mediated Engineering of Human Primary T Cells for Therapy of CD19 +Lymphoid Malignancies", Mol. Therapy, vol. 16, pp. 580-589, 2008.
Huston et al., "Protein engineering of antibody binding sites: Recovery of specific activity in an anti-digoxin single-chain Fv analogue produced in *Escherichia coli*", Proc. Natl. Acad. Sci., USA vol. 85, pp. 5879-5883, Aug. 1988.
June et al., "Engineering lymphocyte subsets: tools, trials and tribulations", Nature Reviews Immunology, vol. 9, No. 10, 29 pages, 2009.
Kabat et al., "Sequences of Proteins of Immunological Interest", U.S. Dept. of Health and Human Services, vol. 1, 1246 pages, 1991.
Kabat et al., "Unusual Distributions of Amino Acids in Complementarity-determining (Hypervariable) Segments of Heavy and Light Chains of Immunoglobulins and Their Possible Roles in Specificity of Antibody-combining Sites", Journal of Biological Chemistry, vol. 252, No. 19, pp. 6609-6616, Oct. 10, 1977.
Kebriaei et al. "First Clinical Trials Employing Sleeping Beauty Gene Transfer System and Artificial Antigen Presenting Cells to Generate and Infuse T Cells Expressing CD19-Specific Chimeric Antigen Receptor", Blood, vol. 122, Issue 21, 3 pages, Nov. 15, 2013.
Knipping et al., "Genome-wide Specificity of Highly Efficient TALENs and CRISPR/Cas9 for T Cell Receptor Modification", Molecular Therapy, Methods & Clinical Development, vol. 4, 12 pages, 2017.
Koneru et al., "A Phase I Clinical Trial of Adoptive T Cell Therapy Using IL-12 Secreting MUC-16ecto Directed Chimeric Antigen Receptors for Recurrent Ovarian Cancer", Journal of Translational Medicine, vol. 13, No. 102, pp. 1-11, 2015.

Kyte et al., "A simple method for displaying the hydropathic character of a protein", Journal of Molecular Biology, vol. 157, Issue 1, pp. 105-132, May 1982.
Liu et al., "Chimeric STAR receptors using TCR machinery mediate robust responses against solid tumors", Science Translation Medicines, vol. 24, No. 13, 16 pages, Mar. 24, 2021.
Lwai et al., "PD-1 blockade inhibits hematogenous spread of poorly immunogenic tumor cells by enhanced recruitment of effector T cells", International Immunology, vol. 17, No. 2, pp. 133-144, Feb. 2005.
Maetzig et al., "Gammaretroviral Vectors: Biology, Technology and Application", Viruses, vol. 3, No. 6, pp. 677-713, Jun. 2011.
Maher et al., "Human T-lymphocyte cytotoxicity and proliferation directed by a single chimeric TCRζ /CD28 receptor", Nature biotechnology, vol. 20, pp. 70-75, 2002.
Mata et al., "Inducible Activation of MyD88 and CD40 in CAR T Cells Results in Controllable and Potent Antitumor Activity in Preclinical Solid Tumor Models", Cancer Discovery, Nov. 2017, vol. 7, No. 11 pp. 1306-1319.
Matta et al, "Use of lentiviral vectors for delivery of small interfering RNA", Cancer biology and therapy, vol. 2, No. 2, pp. 206-210, 2003.
Matta et al., "Kaposi's sarcoma-associated herpesvirus (KSHV) oncoprotein K13 bypasses TRAFs and directly interacts with the IκB kinase complex to selectively activate NF-κB without JNK Activation", Journal of Biological Chemistry, vol. 282, No. 34, pp. 24848-24865, Aug. 24, 2007.
Milone et al., "Chimeric Receptors Containing CD137 Signal Transduction Domains Mediate Enhanced Survival of T Cells and Increased Antileukemic Efficacy In Vivo", Molecular Therapy, vol. 17 No. 8, 1453-1464, Aug. 2009.
Myers et al., "Optimal alignments in linear space" Computer Application Bioscience, vol. 4, No. 1, pp. 11-17, 1988.
Needleman et al., "A general method applicable to the search for similarities in the amino acid sequence of two proteins", J. Mol. Bioi. vol. 48, pp. 443-453, 1970.
Pearson et al., "Improved tools for biological sequence comparison", Proc. Natl. Acad. Sci. USA, vol. 85, pp. 2444-2448, 1988.
Polley et al, "Adoptive Immunotherapy against Experimental Visceral Leishmaniasis with CD8+ T Cells Requires the Presence of Cognate Antigen", Infection and Immunity vol. 74, No. 1, pp. 773-776, Jan. 2016.
Rafiq et al., "Engineering strategies to overcome the current roadblocks in CAR T cell therapy", Nature Reviews Clinical Oncology, vol. 17, No. 3, pp. 147-167. Mar. 2020.
Rowe et al, "Immunization with a Lentiviral Vector Stimulates both CD4 and CD8 T Cell Responses to an Ovalbumin Transgene", Molecular Therapy, vol. 13, No. 2, pp. 310-319, Feb. 2006.
Sadelain et al., "The basic principles of chimeric antigen receptor design", Cancer Discovery, vol. 3, No. 4, pp. 388-398, Apr. 10, 2013.
Salter et al., "Impaired assembly and transport of HLA-A and -B antigens in a mutant TxB cell hybrid", EMBO J., vol. 5, No. 5, pp. 943-949, May 1986.
Sambrook et al., "Molecular Cloning", a Laboratory Manual, vols. 1, 5 pages, 2012.
Sastry et al., "Targeting hepatitis B virus-infected cells with a T-cell receptor-like antibody", Journal of Viralogy, vol. 85, No. 5, pp. 1935-1942, 2011.
Sergeeva et al., "An anti-PR1/HLA-A2 T-cell receptor-like antibody mediates complement-dependent cytotoxicity against acute myeloid leukemia progenitor cells", Immunobiology, Blood, vol. 117, No. 16, pp. 4262-4272, 2011.
Severino et al., "Chimeric immune receptor T cells bypass class I requirements and recognize multiple cell types relevant in HIV-1 infection", Virology, vol. 306, Issue, 2, pp. 371-375, Feb. 15, 2003.
Singh et al., "Redirecting specificity of T-cell populations for CD19 using the Sleeping Beauty system", Cancer Res., vol. 68, No. 8 pp. 2961-2971, Apr. 15, 2008.
Singleton, Paul., "Dictionary of DNA and Genome Technology", 3rd ed., Wiley Black well, 428 pages, Nov. 28, 2012.

(56) References Cited

OTHER PUBLICATIONS

Smith et al., "Ex vivo expansion of human T cells for adoptive immunotherapy using the novel Xeno-free CTS Immune Cell Serum Replacement" Clinical & Translational Immunology, vol. 4, No. 1, e31, 10 pages, 2015.

Smith, Michael B., "March's Advanced Organic Chemistry Reactions, Mechanisms and Structure", 7th ed., J. Wiley & Sons, 9 pages, 2013.

Torikai et al., "A foundation for universal T-cell based immunotherapy: T cells engineered to express a CD19-specific chimeric-antigen-receptor and eliminate expression of endogenous TCR", Blood, vol. 119, No. 24, 19 pages, Jun. 14, 2012.

Verma et al., "TCR Mimic Monoclonal Antibody Targets a Specific Peptide/HLA Class I Complex and Significantly Impedes Tumor Growth In Vivo Using Breast Cancer Models", Journal of Immunology, 2010, vol. 184, No. 4, pp. 2156-2165, 2010.

Willemsen et al., "Grafting primary human T lymphocytes with cancer-specific chimeric single chain and two chain TCR", Gene Therapy, vol. 7, pp. 1369-1377, 2000.

Willemsen et al., A phage display selected Fab fragment with MHC class I-restricted specificity for MAGE-A1 allows for retargeting of primary human T lymphocytes, Gene Therapy, vol. 8, No. 21, pp. 1601-1608, 2001.

Williams., "Sleeping Beauty Vector System Moves Toward Human Trials in the United States", Molecular Therapy, vol. 16, No. 9, pp. 1515-1516, Sep. 2008.

Wu et al., "Remote control of therapeutic T cells through a small molecule-gated chimeric receptor", Science, vol. 350, No. 6258, 21 pages, 2015.

Xiong et al., "Development of tumor targeting anti-MUC-1 multimer: effects of di-scFv unpaired cysteine location on PEGylation and tumor binding", Protein Engineering Design and Selection, vol. 19, No. 8, pp. 359-367, 2006.

Yang et al., "Efficient lysis of Human Immunodeficiency Virus Type 1-infected Cells by Cytotoxic T lymphocytes", Journal of Virology, vol. 70, No. 9, pp. 5799-5806, Sep. 1996.

Yang et al., "Lysis of HIV-1-infected cells and inhibition of viral replication by universal receptor T cells", Proc. Natl. Acad. Sci., USA, Immunology, vol. 94, pp. 11478-11483, Oct. 1997.

Yang et al., "Suppression of Human Immunodeficiency Virus Type 1 Replication by CD8+ Cells: Evidence for HLA Class I-Restricted Triggering of Cytolytic and Noncytolytic Mechanisms", Journal of Virology, vol. 71, pp. 3120-3128, Apr. 1997.

Gross et al., "Expression of immunoglobulin-T-cell receptor chimeric molecules as functional receptors with antibody-type specificity", Proc Natl Acad Sci U S A., vol. 86, No. 24, Dec. 1989, pp. 10024-10028.

Chang et al., "CARs: Synthetic Immunoreceptors for Cancer Therapy and Beyond", Trends in Molecular Medicine, vol. 23, No. 5, May 2017, pp. 430-450.

Eshhar et al., "The Emergence of T-Bodies/CAR T Cells", The Cancer Journal, vol. 20, No. 2, Mar./Apr. 2014, pp. 123-126.

Frigault et al., "Identification of Chimeric Antigen Receptors That Mediate Constitutive or Inducible Proliferation of T Cells", Cancer Immunology Research, vol. 3, No. 4, Apr. 2015, pp. 356-367.

Gross et al., "Endowing T Cells With Antibody Specificity Using Chimeric T Cell Receptors", The FASEB Journal, vol. 6, Dec. 1992, pp. 3370-3378.

Long et al., "4-1BB Costimulation Ameliorates T Cell Exhaustion Induced by Tonic Signaling of Chimeric Antigen Receptors", Nature Medicine, May 4, 2015, 13 pages.

Newick et al., "CAR T Cell Therapy for Solid Tumors", Annual Review of Medicine, vol. 68, 2017, pp. 139-152.

Ruella et al., "Induction of Resistance to Chimeric Antigen Receptor T Cell Therapy by Transduction of a Single Leukemic B Cell", Nature Medicine, vol. 24, Oct. 2018, pp. 1499-1503.

Tokarew et al., "Teaching an Old Dog New Tricks: Next-Generation CAR T Cells", British Journal of Cancer, vol. 120, Nov. 9, 2018, 12 pages.

Shin, Ha Yuon, CRISPR/Cas9 targeting events cause complex deletions and insertions at 17 sites in the mouse genome. Nature Communications, May 31, 2017, 8:15464 | DOI: 10.1038/.

Fu, Yenfang, et al., High-frequency off-target mutagenesis induced by CRISPR-Cas nucleases in human cells. Nature Biotechnology, Jun. 23, 2013, doi:10.1038/nbt.2623.

* cited by examiner

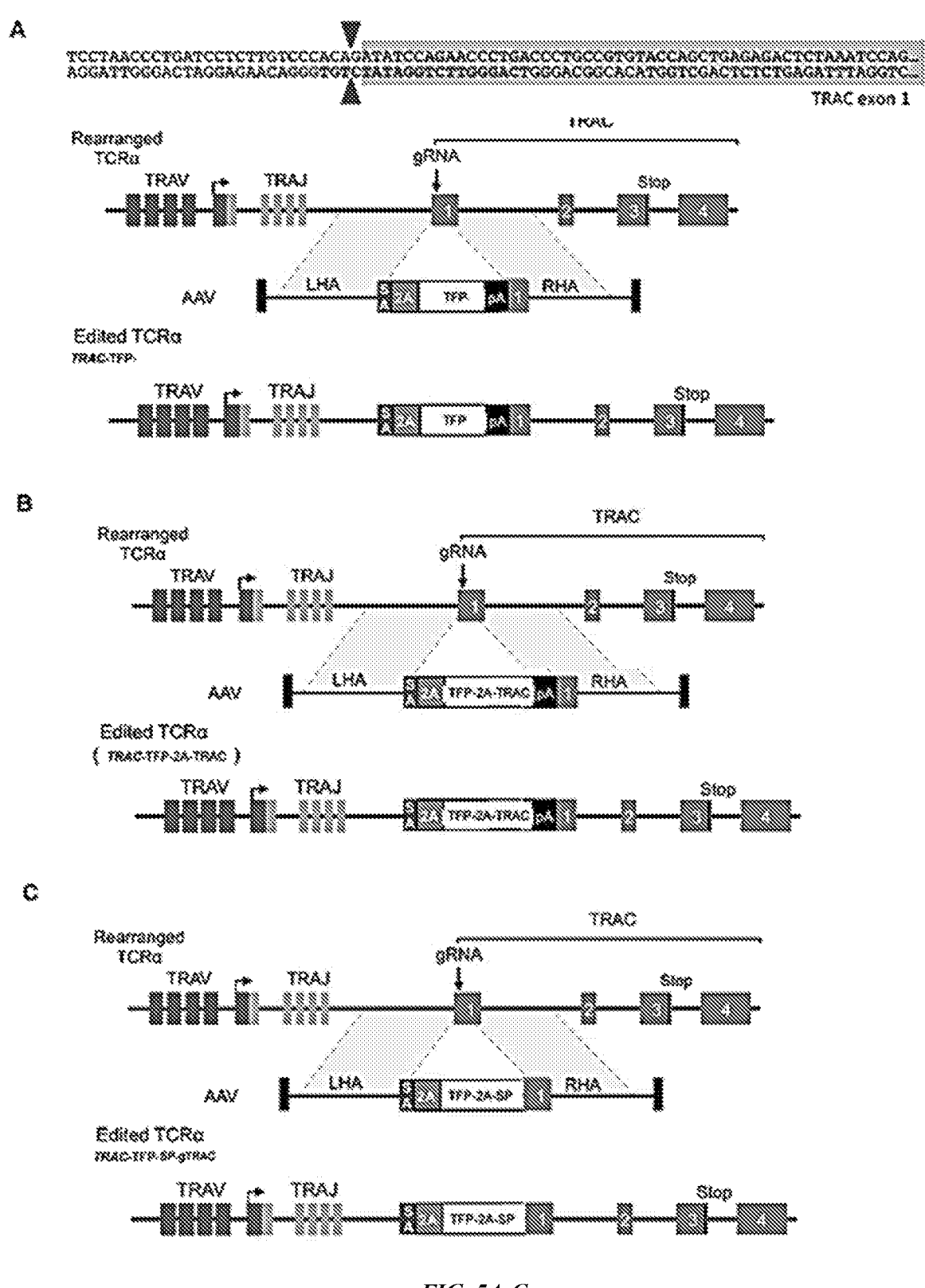
*FIG. 5A-C*

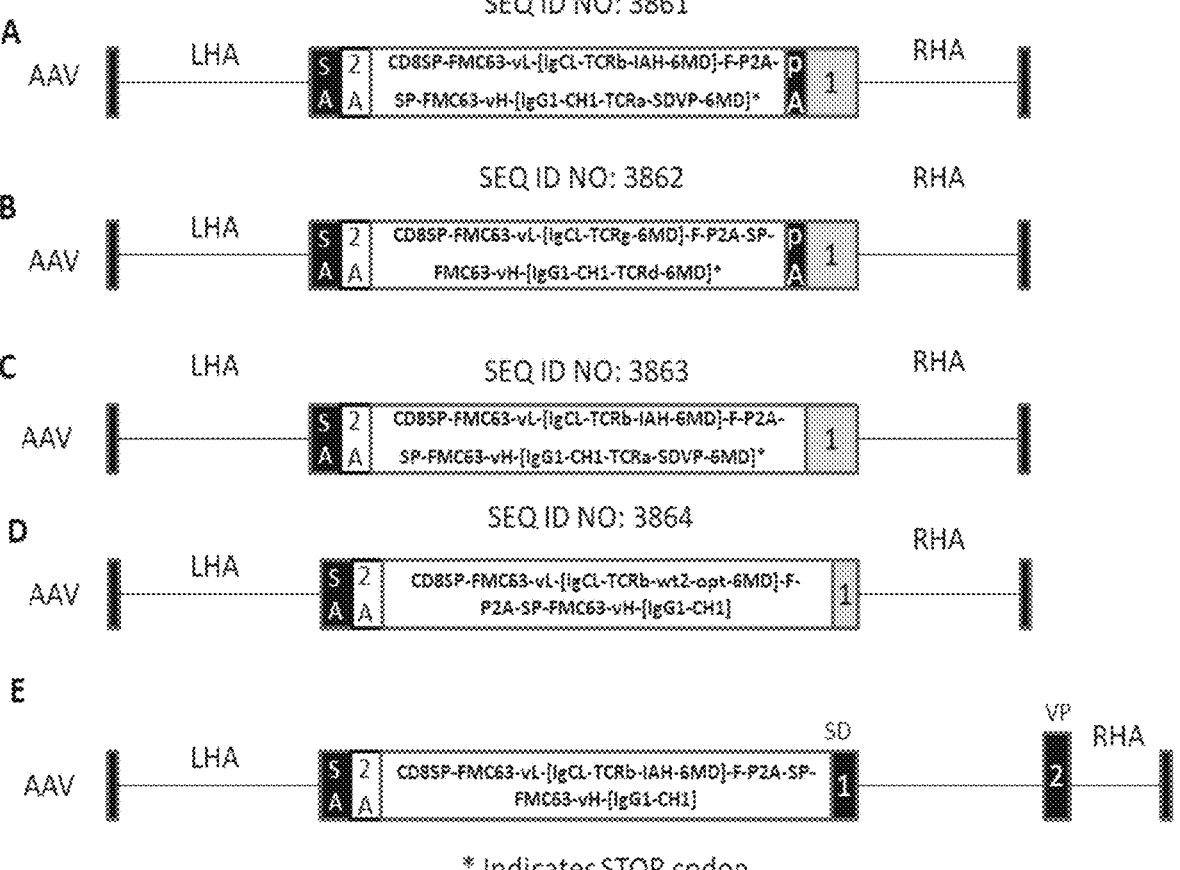
Fig. 6A-E

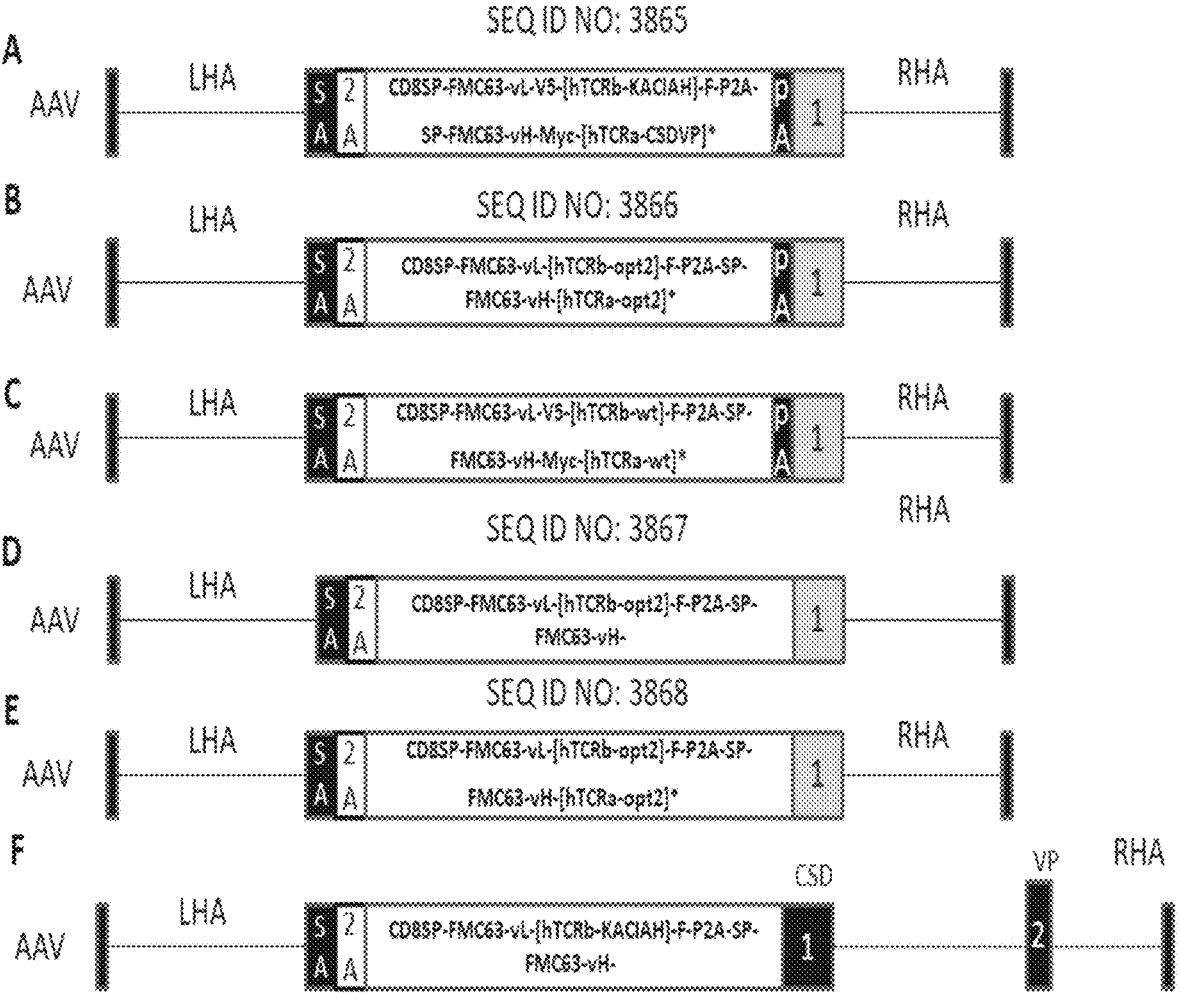
Fig. 7A-F

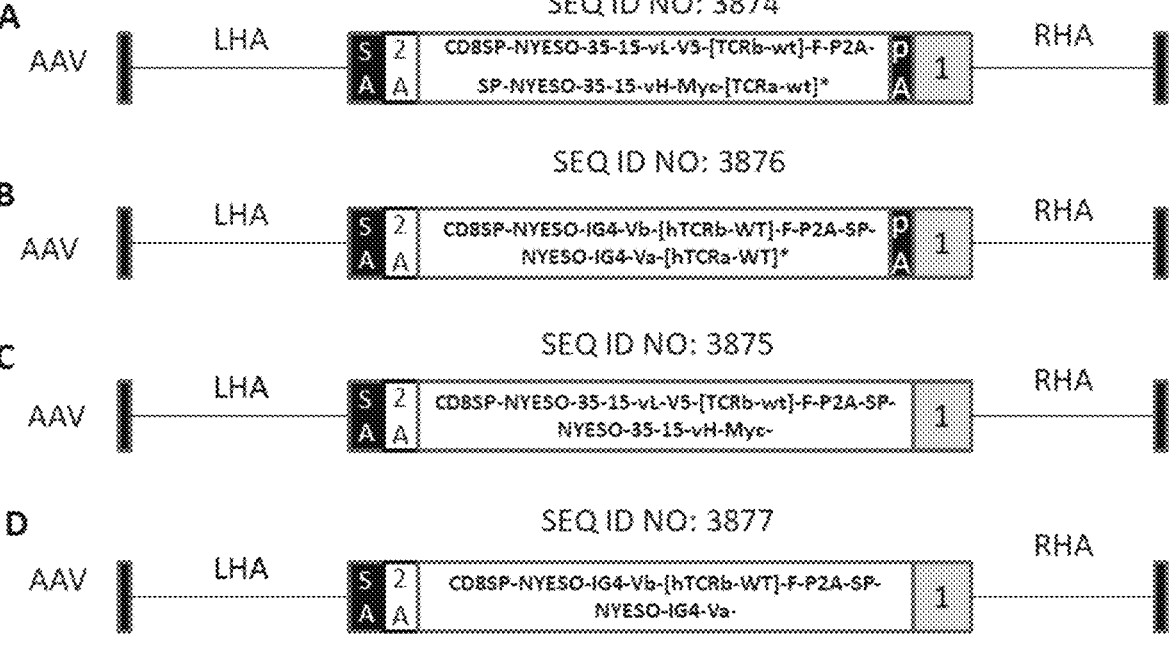
A  AAV  SEQ ID NO: 3874  LHA  CD8SP-NYESO-35-15-vL-V5-[TCRb-wt]-F-P2A-SP-NYESO-35-15-vH-Myc-[TCRa-wt]*  RHA
B  AAV  SEQ ID NO: 3876  LHA  CD8SP-NYESO-IG4-Vb-[hTCRb-WT]-F-P2A-SP-NYESO-IG4-Va-[hTCRa-WT]*  RHA
C  AAV  SEQ ID NO: 3875  LHA  CD8SP-NYESO-35-15-vL-V5-[TCRb-wt]-F-P2A-SP-NYESO-35-15-vH-Myc-  RHA
D  AAV  SEQ ID NO: 3877  LHA  CD8SP-NYESO-IG4-Vb-[hTCRb-WT]-F-P2A-SP-NYESO-IG4-Va-  RHA
* Indicates STOP codon
*Fig. 8A-D*

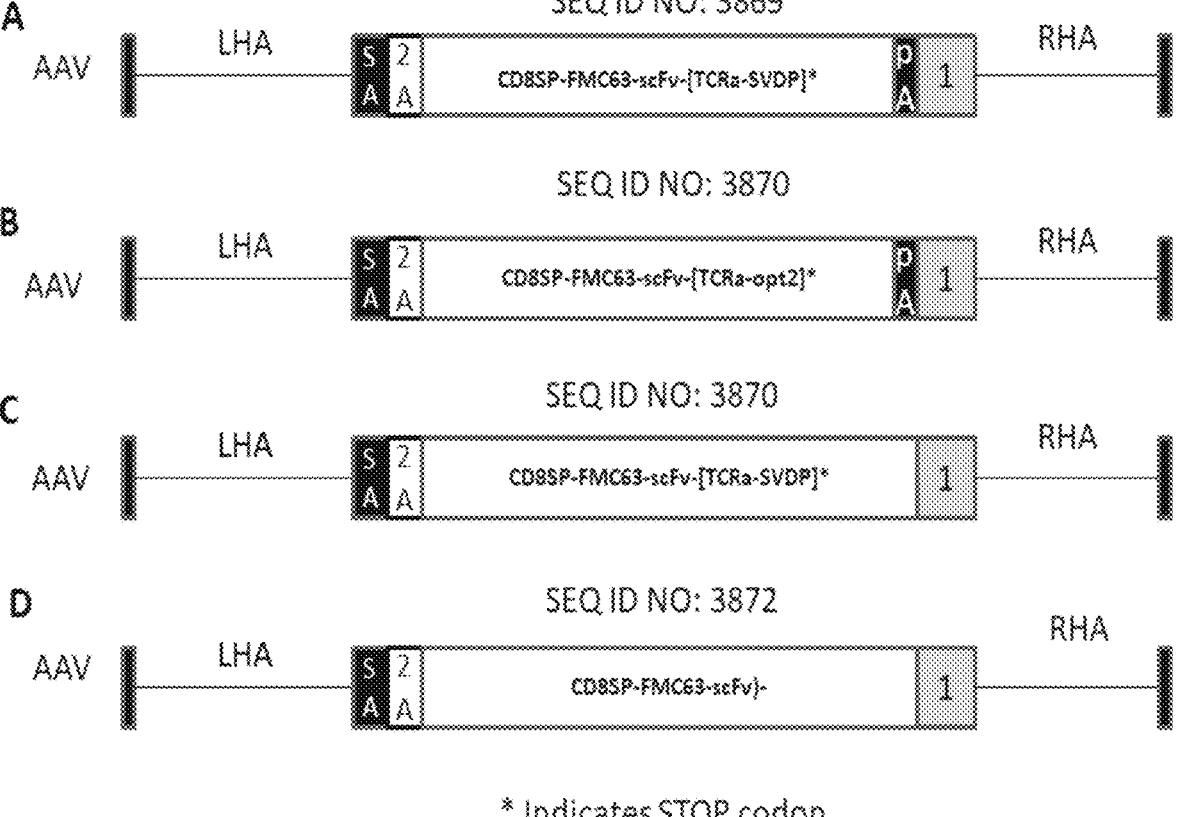
*Fig. 9A-D*

PLATFORMS FOR CO-STIMULATION, NOVEL CAR DESIGNS AND OTHER ENHANCEMENTS FOR ADOPTIVE CELLULAR THERAPY

CROSS REFERENCE TO RELATED APPLICATIONS

This application is a U.S. National Stage Application filed under 35 U.S.C. § 371 and claims priority to International Application No. PCT/US2018/053247, filed Sep. 27, 2018, which application claims priority under 35 U.S.C. § 119 to U.S. Provisional Application Ser. No. 62/564,249, filed Sep. 27, 2017, the disclosures of which are incorporated herein by reference.

TECHNICAL FIELD

Provided herein are novel costimulatory module and novel chimeric antigen receptors for adoptive cellular therapies of cancer, infection, allergic, degenerative and immune disorders.

INCORPORATION BY REFERENCE OF SEQUENCE LISTING

Accompanying this filing is a Sequence Listing entitled "Sequence_ST25.txt", created on Sep. 27, 2018 and having 60,347,260 bytes of data, machine formatted on IBM-PC, MS-Windows operating system. The sequence listing is hereby incorporated herein by reference in its entirety for all purposes.

BACKGROUND

Adoptive T-cell immunotherapy has risen to the forefront of treatment approaches for cancer. T cells can be engineered to express the genes of chimeric antigen receptors (CARs) that recognize tumor associated antigens. CARs are engineered immune-receptors, which can redirect T cells to selectively kill tumor cells. The general premise for their use in cancer immunotherapy is to rapidly generate tumor-targeted T cells, bypassing the barriers and incremental kinetics of active immunization and thereby act as 'living drugs'. Unlike the physiologic T-cell receptor (TCR), which engages HLA-peptide complexes, CARs engage molecules that do not require peptide processing or HLA expression to be recognized. CARs therefore recognize antigen on any HLA background, in contrast to TCRs, which need to be matched to the haplotype of the patient. Furthermore, CARs can target tumor cells that have down-regulated HLA expression or proteasomal antigen processing, two mechanisms that contribute to tumor escape from TCR-mediated immunity. Another feature of the broad applicability of CARs is their ability to bind not only to proteins but also to carbohydrate and glycolipid structures, again expanding the range of potential targets.

SUMMARY

The disclosure provides an immune cell or immune cell population thereof expressing (i) at least one non-naturally occurring immune receptor and (ii) at least one non-naturally occurring agent that selectively activates the NF-κB signaling pathway. In one embodiment, the at least one non-naturally occurring immune receptor comprises at least one antigen-binding domain and at least one transmembrane domain. In another or a further embodiment, the at least one non-naturally occurring immune receptor is capable of recruiting at least one TCR associated signaling module. In another or a further embodiment, the at least one non-naturally occurring immune receptor is a chimeric antigen receptor (CAR) or a recombinant TCR. In another or a further embodiment, the at least one antigen-binding domain of the at least one non-naturally occurring immune receptor binds to an antigen selected from a group consisting of CD5; CD19; CD123; CD22; CD30; CD171; CS1 (also referred to as CD2 subset 1, CRACC, MPL, SLAMF7, CD319, and 19A24); C-type lectin-like molecule-1 (CLL-1 or CLECL1); CD33; epidermal growth factor receptor variant III (EG-FRviii); ganglioside G2 (GD2); ganglioside GD3 (aNeu5Ac (2-8)aNeu5Ac(2-3)bDGalp(1-4)bDG1cp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); sialyl Lewis adhesion molecule (sLe); ganglioside GM3 (aNeu5Ac(2-3)bDClalp(1-4)bDG1cp(1-1) Cer); transglutaminase 5 (TGS5); high molecular weight-melanoma associated antigen (HMWMAA); o-acetyl-GD2 ganglioside (OAcGD2); tumor endothelial marker 1 (TEM1/ CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; survivin; telomerase; prostate carcinoma tumor antigen-1 (PCT A-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin Bl; v-myc avian myelocytomatosis viral oncogene neuroblastoma derived homolog (MYCN); Ras Homolog Family Member C (RhoC); Tyrosinase-related protein 2 (TRP-2); Cytochrome P4501B 1 (CYP1B 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLU), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GM1, PTK7, gpNMB, CDH1-CD324, DLL3, CD276/B7H3, IL11Ra, IL13Ra2, CD179b-IGLl1, TCRgamma-delta, NKG2D, CD32 (FCGR2A), Tn ag, Tim1–/HVCR1, CSF2RA (GM-CSFR-alpha), TGFbetaR2, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Gonadotropin Hormone receptor (CGHR or GR), CCR4, GD3, SLAMF6, SLAMF4, HIV1 envelope glycoprotein, HTLV1-Tax, CMV pp65, EBV-EBNA3c, KSHV K8.1, KSHV-gH, influenza A hemagglutinin (HA), GAD, PDL1, Guanylyl cyclase C (GCC), auto antibody to desmoglein 3 (Dsg3), auto antibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IgE, CD99, Ras G12V, Tissue Factor 1 (TF1), AFP, GPRCSD, Claudin18.2 (CLD18A2 or CLDN18A.2), P-glycoprotein, STEAP1, Liv1, Nectin-4, Cripto, gpA33, BST1/CD157, low conductance chloride channel, and an antigen recognized by TNT antibody. In another or a further embodiment, the at least one non-naturally occurring agent capable of selectively activating NF-κB pathway is selected from the group consisting of vFLIP K13, K13-opt, a NEMO mutant, a NEMO-fusion protein, IKK1-S176E-S180E, IKK2-S177E-S181E, RIP, IKKα, IKKγ, Tcl-1, MyD88-L265, any NF-κB activating protein or protein fragment, any inhibitor of an inhibitor of NF-κB pathway, any gene editing system capable of selectively activating NF-κB, any homolog or variant thereof and any combination thereof. In another or a further embodiment, the at least one non-naturally occurring agent capable of selectively activating NF-κB pathway is of non-viral origin. In another or a further embodiment, the at least one non-naturally occurring agent capable of selectively activating NF-κB pathway is a gene editing system. In another or a further embodiment, the at least one non-naturally occurring agent capable of selectively activating NF-κB pathway induces oligomerization of NEMO/IKKγ. In another or a further embodiment, the at least one non-naturally occurring agent capable of selectively activating NF-κB pathway induces activation of the IKK complex. In another or a further embodiment, at least one the non-naturally occurring agent capable of selectively activating NF-κB pathway does not activate the AKT pathway. In another or a further embodiment, the at least one non-naturally occurring agent capable of selectively activating NF-κB pathway is expressed in a constitutive or inducible manner. In another or a further embodiment, the at least one non-naturally occurring agent capable of selectively activating NF-κB pathway is expressed transiently. In another or a further embodiment, the at least one non-naturally occurring agent capable of selectively activating NF-κB pathway is expressed stably. In another or a further embodiment, the activity of the at least one non-naturally occurring agent capable of selectively activating NF-κB pathway is controlled post-translationally through contacting the cell with a compound. In another or a further embodiment, the at least one non-naturally occurring agent capable of selectively activating NF-κB pathway is expressed as a fusion construct with one or more copies of a switch domain. In another or a further embodiment, the activity of the at least one non-naturally occurring agent capable of selectively activating NF-κB pathway is controlled at the post-translational level by administration of therapeutically effective amount of a compound that induces dimerization of the switch domain. In another or a further embodiment, the switch domain comprises one or more copies of a FKBP12 domain. In another or a further embodiment, the compound is AP20187 or Rimiducid or a homolog thereof. In another or a further embodiment, the immune cell is a T-lymphocyte (T-cell), a CAR-T cell, a TCR-expressing T cell, a tumor infiltrating lymphocyte (TIL), a tissue resident lymphocyte, a stem cell, an induced pluripotent stem cell or a Natural Killer (NK) cell. In another or a further embodiment, the immune cell has been engineered to lack a functional native T-Cell Receptor (TCR) signaling complex and/or β2 microglobulin. In another or a further embodiment, the at least one non-naturally occurring immune receptor and/or the at least one agent capable of selectively activating NF-κB signaling pathway are cloned into an endogenous TCR gene such that the expression of the at least one non-naturally occurring immune receptor and/or the at least one agent capable of selectively activating NF-κB signaling pathway are under control of the endogenous regulatory elements/promoter for the TCR gene. The disclosure also provides for the use of an immune cell or immune cell population as described herein that is used for the prevention and treatment of a disease selected from the group of a cancer, infectious disease, immune disease, and allergic disease. In another or a further embodiment, at least one polynucleotide encodes the at least one non-naturally occurring immune receptor and the at least one non-naturally occurring agent capable of selectively activating NF-κB signaling pathway are expressed from a single promoter. In another or a further embodiment, at least one polynucleotide encoding the at least one non-naturally occurring immune receptor and the at least one non-naturally occurring agent capable of selectively activating NF-κB signaling pathway are expressed using two or more separate promoters. In another or a further embodiment, the at least one polynucleotide comprises a first nucleic acid coding sequence encoding the at least one non-naturally occurring immune receptor separated from a second nucleic acid sequence encoding the non-naturally occurring agent capable of selectively activating NF-κB such that upon expression of the first and second nucleic acid coding sequences that non-naturally occurring immune receptor and non-naturally occurring agent capable of selectively activating NF-κB are not physically or chemically linked. In another or a further embodiment, the at least one non-naturally occurring immune receptor and/or the at least one non-naturally occurring agent capable of selectively activating NF-κB coding polynucleotide(s) are cloned into an endogenous TCR gene such that the at least one non-naturally occurring immune receptor and/or at least one non-naturally occurring agent capable of selectively activating NF-κB are under control of the endogenous regulatory elements/promoter for the TCR gene. In another or a further embodiment, one or more constant chains of the TCR genes are functionally re-expressed.

The disclosure also provides at least one recombinant polynucleotide encoding at least one non-naturally occurring immune receptor, the at least one recombinant polynucleotide comprising (a) a first nucleic acid domain encoding a partial or entire transmembrane and/or cytoplasmic domain and optionally the extracellular domain of an endogenous protein, wherein the endogenous protein is expressed on the surface of lymphocytes and triggers the activation and/or proliferation of the lymphocyte; (b) optionally a polynucleotide a linker; (c) a second nucleic acid domain operably linked to the first nucleic acid domain, wherein the second nucleic acid domain encodes one or more non-natural TCR antigen binding domain(s); (d) an optional third nucleic acid domain encoding a costimulatory domain; and (e) an optional additional nucleic acid domain encoding an accessory module.

The disclosure also provides at least one recombinant polynucleotide comprising a first nucleic acid encoding a non-naturally occurring immune receptor; and a second nucleic acid encoding an accessory module comprising a selective NF-κB activator. In one embodiment, the first nucleic acid and the second nucleic acid are separated by an oligonucleotide linker encoding a cleavable peptide linker. In another embodiment, the at least one comprises two recombinant polynucleotide such that the first nucleic acid and second nucleic acid are expressed from separate vectors. In another or a further embodiment, the selective NF-κB activator is a non-naturally occurring selective NF-κB activator. In another or a further embodiment, the non-naturally occurring immune receptor is selected from the group consisting of a CAR, an Ab-TCR, a TFP, a cTCR, a SIR and a recombinant TCR. In another or a further embodiment, the non-naturally occurring immune receptor comprises an (i) an extracellular antigen specific domain, (ii) a transmembrane domain, and (iii) an optional intracellular signaling domain comprising an immunoreceptor tyrosine-based activation motif (ITAM), wherein (iii) is located at the C-terminus of the non-naturally occurring immune receptor. In another or a further embodiment, upon expression of the first and second nucleic acids sequences the non-naturally occurring immune receptor and selective NF-κB activator polypeptide are not physically or chemically linked. In another or a further embodiment, the extracellular antigen-specific domain binds to any one or more of CD5; CD19; CD123; CD22; CD30; CD171; CS1 (also referred to as CD2 subset 1, CRACC, MPL, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bDGalp(1-4)bDG1cp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); AFP/MHC complex; epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); sialyl Lewis adhesion molecule (sLe); ganglioside GM3 (aNeu5Ac(2-3)bDClalp(1-4)bDG1cp(1-1)Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRCSD); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); WT1/MHC I complex; Cancer/testis antigen 1 (NY-ESO-1); NY-ESO-1/MHC I complex, Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; survivin; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin Bl; v-myc avian myelocytomatosis viral oncogene neuroblastoma derived homolog (MYCN); Ras Homolog Family Member C (RhoC); Tyrosinase-related protein 2 (TRP-2); Cytochrome P4501B 1 (CYP1B 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); HPV E6/MHC I complex; human papilloma virus E7 (HPV E7); HPV E7/MHC I complex; AFP/MHC I complex; Ras/MHC I complex; intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GM1, PTK7, gpNMB, CDH1-CD324, DLL3, CD276/B7H3, IL11Ra, IL13Ra2, CD179b-IGLl1, TCRgamma-delta, NKG2D, CD32 (FCGR2A), Tn ag, Tim1–/HVCR1, CSF2RA (GM-CSFR-alpha), TGF-betaR2, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Gonadotropin Hormone receptor (CGHR or GR), CCR4, GD3, SLAMF6, SLAMF4, HIV1 envelope glycoprotein, HTLV1-Tax, CMV pp65, EBV-EBNA3c, KSHV K8.1, KSHV-gH, influenza A hemagglutinin (HA), GAD, PDL1, Guanylyl cyclase C (GCC), auto antibody to desmoglein 3 (Dsg3), auto antibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IgE, CD99, Ras G12V, Tissue Factor 1 (TF1), AFP, GPRCSD, Claudin18.2 (CLD18A2 or CLDN18A.2), P-glycoprotein, STEAP1, Liv1, Nectin-4, Cripto, gpA33, BST1/CD157, low conductance chloride channel, and an antigen recognized by TNT antibody. In another or a further embodiment, the selective NF-κB activator is selected from the group consisting of vFLIP K13, a NEMO mutant, a NEMO-fusion protein, IKK1-S176E-S180E, IKK2-S177E-S181E, RIP, FKBPx2-RIP-ID, IKK1, FKBPx2-IKKa, IKK2, FKBPx2-IKK2, Tcl-1, MyD88-L265, any NF-κB activating protein or protein fragment, any inhibitor of an inhibitor of NF-κB pathway, a gene editing system capable of selectively activating NF-κB, an RNA interference system that selectively activating NF-κB and any combination thereof.

In another or a further embodiment, the selective NF-κB activator is expressed as a fusion construct with one or more copies of FKBP domain. In another or a further embodiment, the extracellular antigen specific domain is selected from the group consisting of: the variable region of the heavy chain (vH) of an antibody or a fragment thereof specific for a predefined target antigen; the variable region of the light chain (vL) of an antibody or a fragment thereof specific for a predefined target antigen; a single chain variable fragment (scFv) or a fragment thereof specific for a predefined target antigens; an antibody fragment (e.g., Fv, a Fab, a (Fab')2) specific for a predefined target antigen; a single domain antibody (SDAB) fragments specific for a predefined target antigen; a camelid vHH domain specific for a predefined target antigen; a non-immunoglobulin antigen binding scaffolds specific for a predefined target antigen; a receptors specific or a fragment thereof for a predefined target antigen; a ligands or a fragment thereof specific for a predefined target antigen; a bispecific-antibody, -antibody fragment, -scFV, -vHH, -SDAB, -non-immunoglobulin antigen binding scaffold, -receptor or -ligand specific for one or more predefined target antigens; and an autoantigen or a fragment thereof.

The disclosure also provides at least one vector comprising the at least one polynucleotide of any of the foregoing polynucleotides constructs described herein and above. In one embodiment, the vector is selected from the group consisting of a DNA vector, an RNA vector, a plasmid, a lentivirus vector, adenoviral vector, AAV vector, a retrovirus vector, a baculovirus vector, a sleeping beauty transposon vector, and a piggybac transposon vector.

The disclosure also provides an immune effector cell or stem cell comprising at least one recombinant polynucleotide, construct or vector described herein and above. In one embodiment the immune cell is an antigen presenting cell. In another or a further embodiment, the immune effector cell is a human T cell, a human NKT cell or a synthetic T cell, NK cell, or a stem cell that can give rise to an immune effector cell, optionally, wherein the T cell is diaglycerol kinase (DGK) and/or Ikaros deficient and/or Brd4 deficient.

The disclosure also provides a method to (i) extend the life span of an immune cell expressing, (ii) stimulate proliferation of an immune cell, (iii) stimulate cytokine production by an immune cell, (iv) enhance antigen presentation by an immune cell, (v) protect an immune cell from apoptosis, the method comprising transfecting or transforming the immune cells with a polynucleotide encoding a selective NF-κB activator or a NF-κB specific stimulatory polypeptide. In one embodiment, the selective NF-κB activator or a NF-κB specific stimulatory polypeptide is selected from the group consisting of vFLIP K13, K13-opt, a NEMO mutant, a NEMO-fusion protein, IKK1-S176E-S180E, IKK2-S177E-S181E, RIP, IKKα, IKKβ, Tcl-1, MyD88-L265, any NF-κB activating protein or protein fragment, any inhibitor of an inhibitor of NF-κB pathway, any homolog or variant thereof and any combination thereof. In another or a further embodiment, the selective NF-κB activator or a NF-κB specific stimulatory polypeptide is expressed in a constitutive or inducible manner In another or a further embodiment, the selective NF-κB activator or a NF-κB specific stimulatory polypeptides controlled post-translationally through contacting the T cell with a compound. In another or a further embodiment, the selective NF-κB activator or a NF-κB specific stimulatory polypeptide is expressed as a fusion construct with one or more copies of FKBP domain. In another or a further embodiment, the activity of the selective NF-κB activator or a NF-κB specific stimulatory polypeptide is controlled at the post-translational level by administration of therapeutically effective amount of a compound that induces dimerization of the FKBP domain. In another or a further embodiment, the compound is AP20187 or rimiducid.

The disclosure also provides a method of making a non-naturally occurring immune receptor-expressing immune effector cell, comprising introducing at least one vector or at least one recombinant polynucleotide construct of the disclosure into an immune effector cell or a hematopoietic stem cell or progenitor cell that can give rise to an immune effector cell, under conditions such that a non-naturally occurring immune receptor is expressed and the immune effector cell comprises (i) extended life span, (ii) improved T cell proliferation, and/or (iii) reduced apoptosis compared to a CAR-T cell lacking an NFkB specific stimulatory polypeptide. In another or a further embodiment, the method further comprises providing a population of immune effector cells; and removing T regulatory cells from the population, thereby providing a population of T regulatory-depleted cells; wherein the steps are performed prior to introducing the vector or recombinant polynucleotide encoding the CAR and/or NFkB specific stimulatory polypeptide to the population. In another or a further embodiment, the T regulatory cells are removed from the cell population using an anti-CD25 antibody, or an anti-GITR antibody. In another or a further embodiment, the method further comprises a) providing a population of immune effector cells; and b) enriching P-glycoprotein (P-gp or Pgp; MDR1, ABCB1, CD243)-positive cells from the population, thereby providing a population of P-glycoprotein (P-gp or Pgp; MDR1, ABCB1, CD243)-enriched cells; wherein steps a) and b) are performed prior to or after introducing the vector or recombinant polynucleotide encoding the CAR and/or NFkB specific stimulatory polypeptide. In another or a further embodiment, the P-glycoprotein positive cells are enriched using any one or more of the methods selected from the group consisting of i) immunoselection using one or a cocktail of P-glycoprotein specific antibodies, ii) staining with one or more of fluorescent dyes that are substrates of P-glycoprotein, tetramethylrhodamine methyl ester (TMRM), Adriamycin and actinomycin-D) under conditions at which P-glycoprotein is active as a pump and enriching for cells that stain less with the dye, iii) selection of cells that are resistant to phototoxic compounds that are substrates of P-glycoprotein, such as any one or more of TH9402, 2-(4, 5-dibromo-6-amino imino-3H-xanthen-9-yl)-benzoic acid methyl ester hydrochloride, 2-(4,5-dibromo-6-amino imino-3H-xanthen-9-yl)-benzoic acid ethyl ester hydrochloride, 2-(4,5-dibromo-6-amino imino-3H-xanthen-9-yl)-benzoic acid octyl ester hydrochloride, 2-(4,5-dibromo-6-amino imino-3H-xanthen-9-yl)-benzoic acid n-butyl ester hydrochloride, 2-(6-ethyl amino-3-ethyl imino-3H-xanthen-9-yl)-benzoic acid n-butyl ester hydrochloride, or derivatives thereof or combinations thereof, and iv) selection of cells that are resistant to cytotoxic compounds that are substrates of P-glycoprotein, such as vincristine, vinblastine, taxol, paclitaxel, mitoxantrone, etoposide, adriamycin, daunorubicin and actinomycin-D.

The disclosure also provide a method of generating a population of RNA-engineered cells comprising introducing in vitro transcribed RNA or RNAs or synthetic RNA or RNAs into a cell or population of cells, where the RNA or RNAs comprises a recombinant polynucleotide or polynucleotides of the disclosure.

The disclosure also provides a method of providing anti-disease immunity in a subject comprising administering to the subject an effective amount of the immune effector cell or a stem cell that can give rise to an immune effector cell of the disclosure, wherein the cell is an autologous T cell or an allogeneic T cell, or an autologous NKT cell or an allogeneic NKT cell or an autologous or an allogeneic hematopoietic stem cell or an autologous or an allogeneic iPSC that can give rise to an immune effector cell. In another or a further embodiment, the allogeneic T cell or allogeneic NKT cell or hematopoietic stem cell or iPSC lacks expression or has low expression of a functional TCR or a functional HLA.

The disclosure also provides a composition comprising an immune effector cell or a stem cell that can generate immune effector cells comprising a non-naturally occurring immune receptor and a selective NFkB activator, wherein the non-naturally occurring immune receptor comprises an antigen binding domains that bind to a disease-associated antigen associated said disease-associated antigen is selected from a group consisting of: CD5, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bD-Galp(1-4)bDG1cp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); FmsLike Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDClalp(1-4) bDG1cp(1-1)Cer); transglutaminase 5 (TGS5); high molecular weight-melanoma associated antigen (HMW-MAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRCSD); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin Bl; v-myc avian myelocytomatosis viral oncogene neuroblastoma derived homolog (MYCN); Ras Homolog Family Member C (RhoC); Tyrosinase-related protein 2 (TRP-2); Cytochrome P4501B 1 (CYP1B 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation End products (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLU), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGL11, ALK TCRgamma-delta, NKG2D, CD32 (FCGR2A), CSPG4-HMW-MAA, Tim1–/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Chorionic Gonadotropin Hormone receptor (CGHR), CCR4, SLAMF6, SLAMF4, HIV1 envelope glycoprotein, HTLV1-Tax, CMV pp65, EBV-EBNA3c, influenza A hemagglutinin (HA), GAD, PDL1, Guanylyl cyclase C (GCC), KSHV-K8.1 protein, KSHV-gH protein, auto-antibody to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA- DR, HLA-G, IGE, CD99, RAS G12V, Tissue Factor 1 (TF1), AFP, GPRCSD, claudin18.2 (CLD18A2 OR CLDN18A.2)), P-glycoprotein, STEAP1, LIV1, NECTIN-4, CRIPTO, GPA33, BST1/CD157, low conductance chloride channel, and antigen recognized by TNT antibody.

The disclosure also provides a method of treating or preventing a disease associated with expression of a disease-associated antigen in a subject, comprising administering to the subject an effective amount of an immune effector cell comprising a non-naturally occurring immune receptor and a selective NFkB activator, wherein the non-naturally occurring immune receptor comprises an antigen binding domains that bind to a disease-associated antigen associated said disease-associated antigen is selected from a group consisting of: CD5, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bDGalp(1-4)bDG1cp(1-1) Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); FmsLike Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EP-CAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDClalp(1-4)bDG1cp(1-1)Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRCSD); chromosome X open reading frame 61 (CX-ORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin Bl; v-myc avian myelocytomatosis viral oncogene neuroblastoma derived homolog (MYCN); Ras Homolog Family Member C (RhoC); Tyrosinase-related protein 2 (TRP-2); Cytochrome P4501B 1 (CYP1B 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation End products (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLU), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGLl1, ALK TCR-gamma-delta, NKG2D, CD32 (FCGR2A), CSPG4-HMW-MAA, Tim1-/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Chorionic Gonadotropin Hormone receptor (CGHR), CCR4, SLAMF6, SLAMF4, HIV1 envelope glycoprotein, HTLV1-Tax, CMV pp65, EBV-EBNA3c, influenza A hemagglutinin (HA), GAD, PDL1, Guanylyl cyclase C (GCC), KSHV-K8.1 protein, KSHV-gH protein, auto-antibody to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRCSD, claudin18.2 (CLD18A2 OR CLDN18A.2)), P-glycoprotein, STEAP1, LIV1, NECTIN-4, CRIPTO, GPA33, BST1/CD157, low conductance chloride channel, and antigen recognized by TNT antibody, thereby treating the subject or preventing a disease in the subject. In another or a further embodiment, the disease associated with expression of the disease associated antigen is selected from the group consisting of a proliferative disease, a precancerous condition, a cancer, and a non-cancer related indication associated with expression of the disease-associated antigen. In another or a further embodiment, the cancer is a hematologic cancer chosen from one or more of chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), B cell prolymphocytic leukemia, blastic plasmacytoid dendritic cell neoplasm, Burkitt's lymphoma, diffuse large B cell lymphoma, primary effusion lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, or pre-leukemia. In another or a further embodiment, the cancer is selected from the group consisting of colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, Merkel cell cancer, epidermoid cancer, squamous cell cancer, T-cell lymphoma, environmentally induced cancers, combinations of said cancers, and metastatic lesions of said cancers. In another or a further embodiment, the disease is associated with infection by a virus including but not limited to HIV1, HIV2, HTLV1, Epstein Barr virus (EBV), cytomegalovirus (CMV), adenovirus, adeno-associated virus, BK virus, Human Herpesvirus 6, Human Herpesvirus 8 influenza virus, parainfluenza virus, avian flu virus, MERS and SARS coronaviruses, Crimean Congo Hemorrhagic fever virus, rhino virus, enterovirus, Dengue virus, West Nile virus, Ebola virus, Marburg virus, Lassa fever virus, zika virus, RSV, measles virus, mumps virus, rhino virus, varicella virus, herpes simplex virus 1 and 2, varicella zoster virus, HIV-1, HTLV1, Hepatitis virus, enterovirus, hepatitis B virus, Hepatitis C virus, Nipah and Rift valley fever viruses, Japanese encephalitis virus, Merkel cell polyomavirus, or is associated with infection with *Mycobacterium tuberculosis*, atypical mycobacteria species, *Pneumocystis jirovecii*, toxoplasmosis, rickettsia, nocardia, aspergillus, mucor, or candida. In another or a further embodiment, the disease is an immune or degenerative disease including but not limited to diabetes mellitus, multiple sclerosis, rheumatoid arthritis, pemphigus vulgaris, ankylosing spondylitis, Hoshimoto's thyroiditis, SLE, sarcoidosis, scleroderma, mixed connective tissue disease, graft versus host disease or Alzheimer's disease.

The details of one or more embodiments of the invention are set forth in the accompanying drawings and the description below. Other features, objects, and advantages of the invention will be apparent from the description and drawings, and from the claims.

BRIEF DESCRIPTION OF THE DRAWINGS

FIG. 5A-C shows CRISPR/Cas9-mediated TFP gene targeting into the TRAC locus and strategies to rescue TRAC expression. a, Top, TRAC locus with the 5' end (grey) of the TRAC first exon, the TRAC gRNA (blue) and the corresponding PAM sequence (red). The two blue arrows indicate the predicted Cas9 double strand break. Bottom, CRISPR/Cas9-targeted integration into the TRAC locus. The targeting construct (AAV) contains a splice acceptor (SA), followed by a F2A coding sequence, the TFP gene and a polyA sequence, flanked by sequences homologous to the TRAC locus (LHA and RHA, left and right homology arm). Once integrated, the endogenous TCRα promoter drives TFP expression, while the TRAC locus is disrupted. B) The targeting construct expresses TFP and coexpresses TRAC (TCRα constant chain) through a 2A sequence. C) The targeting construct epressesses TFP and coexpresses via a 2A sequence a signal peptide which is in frame with the first exon present in the RHA so that TCRα promoter drives TFP expression as well as that of TRAC which is lacking the TCRα variable region (TRAV); TRAJ, TCRα joining region; 2A, the self-cleaving 2A sequence. pA: SV40/β-globin polyA sequence.

FIG. 6A-E shows various contruct designs for targeting cassette to direct an Ab-TCR to the TRAC locus.

FIG. 7A-F shows various contruct designs for targeting cassette to direct a cTCR (SIR) to TRAC locus.

FIG. 8A-D shows various contruct designs for targeting cassette to direct a cTCR (SIR) and a TCR to TRAC locus.

FIG. 9A-D shows various contruct designs for targeting cassette to direct a single chain cTCR (SIR) to TRAC locus.

DETAILED DESCRIPTION

Figure 1:
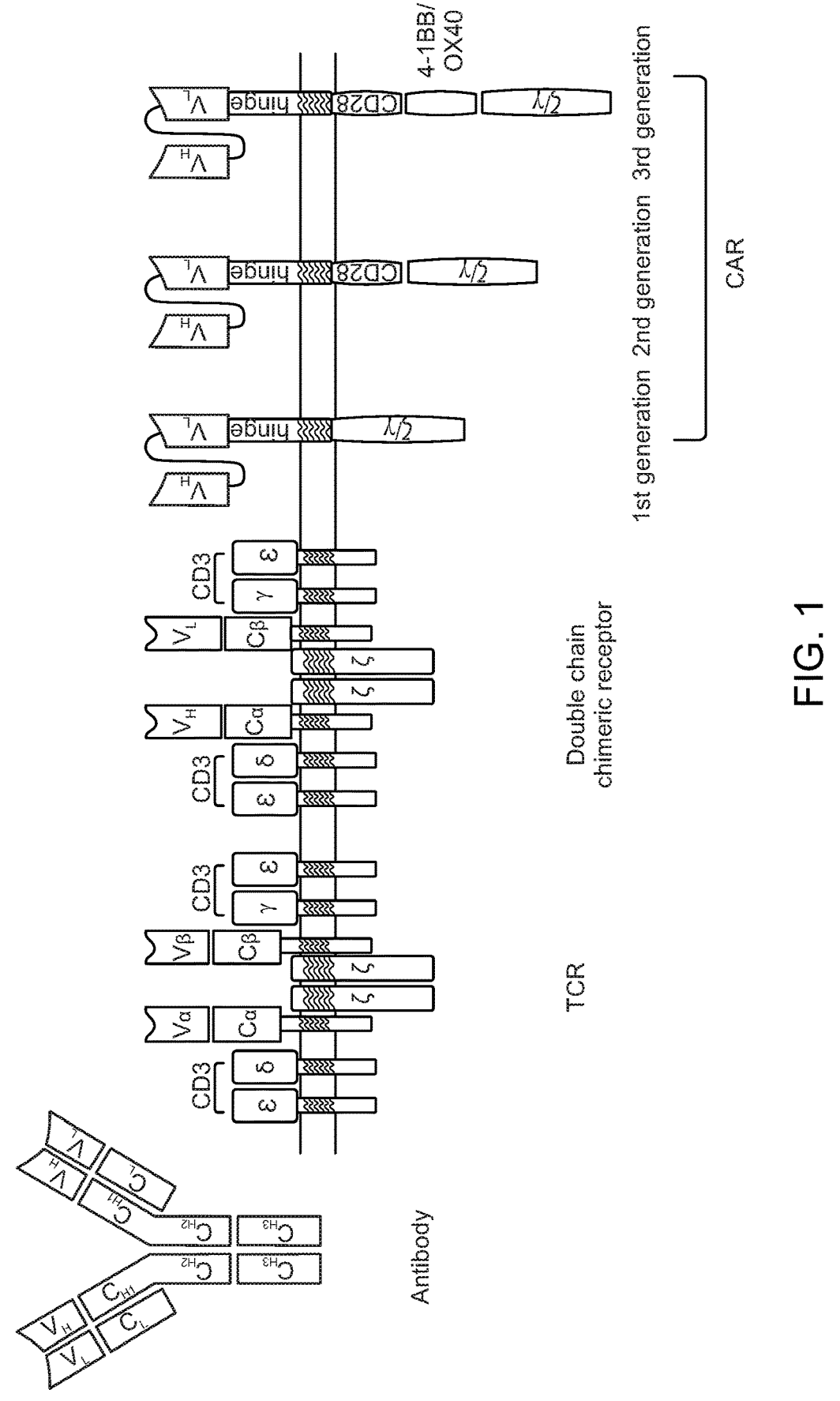
FIG. 1 depicts a cartoon of current an antibody, T-cell receptor (TCR), CAR and next generation CARs and SIRs.

Initial first-generation CARs were constructed through the fusion of a scFv (single chain fragment variable)-based antigen binding domain to an inert CD8 transmembrane domain, linked to a cytoplasmic signaling domain derived from the CD3-ζ or Fc receptor γ chains (FIG. 1).

Although CD3-ζ chain aggregation is sufficient to enable lytic activity of T-cells, they failed to elicit a robust cytokine response, including interleukin-2 (IL-2), and support T-cell expansion upon repeated exposure to antigen. For optimal activation and proliferation, T cells require both T-cell receptor engagement and signaling, as well as costimulatory signaling through costimulatory receptors (i.e., CD28, 4-1BB, OX-40) on T cells binding to cognate ligands (i.e., CD80/86, 4-1BBL, OX-40L) expressed either by the targeted tumor cell or the antigen-presenting cells. To overcome the lack of T-cell co-stimulation, first generation CARs were further modified by incorporating the cytoplasmic signaling domains of T-cell costimulatory receptors. These second-generation CARs enhanced signaling strength and persistence of the modified T cells, leading to superior antitumor activity. Signaling through the costimulatory domains present in the 2nd generation CAR constructs results in activation of several signaling pathways, such as NF-κB and ERK. In particular, AKT activation promotes T cell activation but has been also shown to results in terminal differentiation, exhaustion and lack of persistence.

Figure 2:
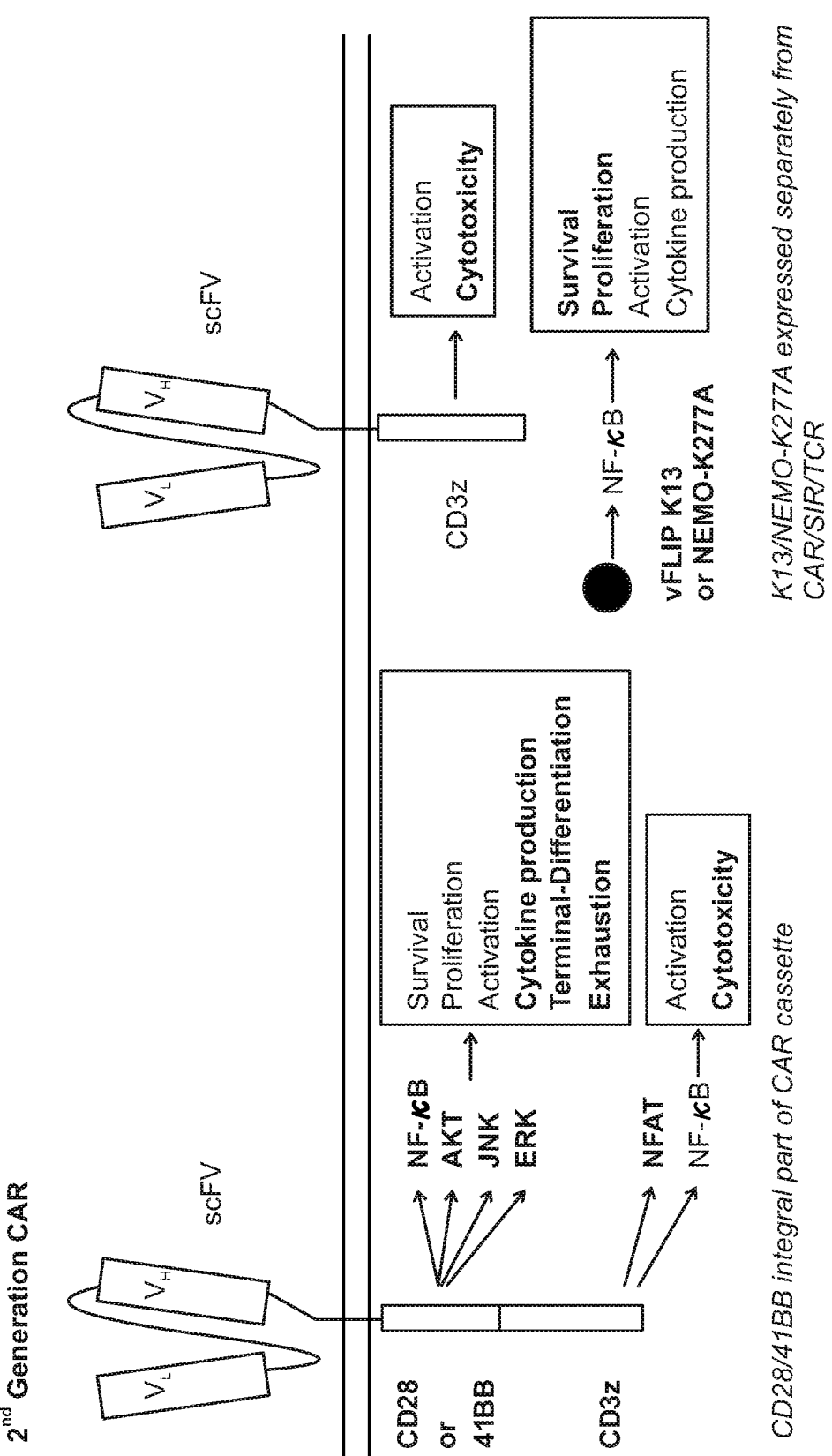
FIG. 2 depicts a cartoon comparing second generation CAR biological activity and structure to an embodiment of the present disclosure depicting a CAR lacking CD28 or 41BB but expressing a NF-κB stimulatory molecule (NEMO and/or K13, or mutants thereof).

FIG. 2 depicts a cartoon of a $2^{nd}$ generation CAR as described above next to a first generation CAR plus a specific NF-κB stimulatory molecule depicting the biological activity associated with each.

The CAR constructs in current clinical use are artificial in design as they represent fusion of several different proteins. In particular, inclusion of co-stimulatory domain in the $2^{nd}$ generation CAR construct results in non-physiological signaling through the receptor, which in turn could contribute to their toxicity. Some CARs show tonic antigen-independent signaling, which leads to unrestrained cellular activation, eventually resulting in apoptosis, excessive cytokine release independent of cognate antigens, and immunologic exhaustion. Tonic signaling through co-stimulatory domains (e.g., 41BB and CD28 domain) has been shown to impede T cell survival. Thus, there is a need for improving the CAR design to achieve long term persistence of CAR modified T cells without the risk of excessive toxicity, such as cytokine release syndrome (CRS).

To overcome some of the design limitation of conventional $2^{nd}$ generation CARs, several alternative designs, collectively termed next generation CARs, have been described, including Ab-TCR (WO 2017/070608 A1 incorporated herein by reference), TCR receptor fusion proteins or TFP (WO 2016/187349 A1 incorporated herein by reference), Synthetic Immune Receptors (SIRs) (see, WO 2018/102795 A1, incorporated herein by reference), Tri-functional T cell antigen coupler (Tri-TAC) (see, WO 2015/117229 A1, incorporated herein by reference). These alternative CAR designs, in general, lack a co-stimulatory domain.

To overcome the limitations of AKT activation and tonic signaling, this disclosure demonstrates the use of selective NF-κB activators, such as NEMO-mutants (e.g., hNEMO-K277A, hNEMO-K277A-DeltaV249-K255, mouse NEMO-K270A), K13-opt, IKK2-S177E-5181E, or IKK1-5176E-5180E, to provide costimulatory function. In contrast to 41BB- and CD28-derived costimulatory domains that activate a multitude of signaling pathways (see, $2^{nd}$ and $3^{rd}$ generation CARs in FIG. 1), selective NF-κB activators, such as, for example, hNEMO-K277A, hNEMO-K277A-DeltaV249-K255, mouse NEMO-K270A, K13-opt, IKK2-S177E-5181E, or IKK1-5176E-5180E, selectively activate the NF-κB pathway by activating the I-kappaB kinase (IKK)

complex. The disclosure further describes an alternative non-naturally occurring immune receptor, e.g., CAR, design in which the costimulation is provided by an accessory module comprising a selective NF-κB activator that is co-expressed with the non-naturally occurring immune receptor (e.g., a CAR). However, in contrast to the 2$^{nd}$ generation CAR constructs in which the co-stimulatory domain is a component of the mature CAR polypeptide, the accessory module comprising the selective NF-κB activator is not necessarily an integral part of the mature immune receptor e.g., CAR, polypeptide. Such a design has advantage as it overcomes the problems of tonic signaling, excessive cytokine production and early exhaustion of T cells caused by the aggregation and non-physiological signaling through the costimulatory domains. The disclosure further provides a method to regulate the activity of the NF-κB activators by expressing them in fusion with switch domains, such as in fusion with tandem copies of a FKBP12v36 domain.

The disclosure demonstrates that expression of selective NF-κB activators, such, for example, as hNEMO-K277A, hNEMO-K277A-DeltaV249-K255, mouse NEMO-K270A, IKK2-S177E-S181E, IKK1-5176-5180E and K13-opt, in T cells extends their ability to proliferate long term in culture without undergoing senescence, thereby demonstrating for the first time that activation of a single pathway (i.e., NF-κB) is sufficient for postponing senescence of T cells. For example, CD19-CAR constructs co-expressing hNEMO-K277A or hNEMO-K277A-DeltaV249-K255 but lacking any costimulatory domain demonstrate superior in vivo efficacy as compared to 2nd generation CAR construct containing the 41BB costimulatory domain. The disclosure further demonstrates that selective activation of NF-κB is sufficient to promote the proliferation of T cells, delay senescence and improve the performance of T cells for adoptive cell therapy, including CAR-T cell therapy. Thus, the disclosure provides composition and methods to enhance the survival, proliferation, cytokine secretion, delay exhaustion and senescence and improve the in vivo expansion, persistence and anti-tumor activity of an immune cell, e.g., T cell, e.g., CAR-T or TCR-T or SIR-T cell, and/or an immune cell expressing a non-naturally occurring immune receptor, via selective or preferential (i.e., without AKT activation) activation of the NF-κB pathway in the immune cell. Moreover, the disclosure demonstrates that the use of selective NF-κB activators, such as, for example, hNEMO-K277A or hNEMO-K277A-DeltaV249-K255, is not limited to its use in CAR-T cells as they can be used in any T cell for adoptive cellular therapy, including T cells expressing endogenous TCR (e.g., tumor infiltrating lymphocytes), exogenous TCR, SIR and the like.

The disclosure further demonstrates that selective NF-κB activators, such as, for example, hNEMO-K277A, hNEMO-K277A-DeltaV249-K255, mouse NEMO-K270A, K13-opt, IKK2-S177E-5181E, or IKK1-5176E-5180E, can be used to improve the performance of vaccines by promoting cytokine secretion and antigen presentation by immune cells, e.g., antigen presenting cells, e.g., dendritic cells. For example, bone marrow derived dendritic cells (DC) expressing selective NF-κB activators, such as hNEMO-K277A, hNEMO-K277A-DeltaV249-K255, mouse NEMO-K270A, K13-opt, IKK2-5177E-5181E, or IKK1-5176E-5180E, show superior cytokine production, antigen presentation, and immune response (e.g., anti-tumor response or anti-infectious agent response) as compared to control DC.

The disclosure further provides NF-κB activators, including selective NF-κB activators that are of human origin and therefore are less immunogenic.

The disclosure further provides NF-κB activators, including selective NF-κB activators that can be expressed in the cytosol. The disclosure further provides NF-κB activators, including selective NF-κB activators, that are constitutively active and do not require a stimulus, e.g., treatment with a ligand, for their ability to activate NF-κB.

The disclosure further provides several antigen binding domains that can be used in the generation of conventional CARs (e.g., 2nd generation CAR containing 41BB costimulatory domain) as well next generation CARs such as SIRs, zSIRs, Ab-TCR, and TFPs, for applications in adoptive cellular therapy. In some embodiments, these antigen binding domains are derived from antibodies and target antigens expressed in both hematologic malignancies and solid tumors. The SEQ ID Nos. of vL, vH and scFv fragments of these antigen binding domains are shown in Tables 6A-C. The SEQ ID Nos of the complementary determining regions (CDRs) of the light (vL) and heavy (vH) chains are shown in Tables 6A-B. The nucleic acid and amino acid SEQ IDs of exemplary 2nd generation CARs containing 41BB costimulatory domains and next generation CARs (e.g., zCAR-K13, zCAR-NEMO-K277A, SIRs, Ab-TCRs and TFP) based on these antigen binding domains are provided in Tables 10-14. The CARs containing these antigen binding domains show diverse in vitro and in vivo properties, such as binding affinity to the target antigens, cytokine secretion, proliferation, cyototoxicity, exhaustion, and long term persistence. As such, the non-naturally occurring immune receptors, e.g., CARs, containing these target antigens can be used to generate a diverse immune response. The polynucleotide, polypeptides, expression constructs, recombinantly engineered cells expressing CARs comprising the antigen binding domains of the disclosure, as well as method of making and using such polypeptides, polynucleotides and cells are described in methods known in the art and methods described in PCT/US2017/024843, WO 2014/160030 A2, WO 2016/187349 A1, WO 2017/070608 A1 and WO 2018/102795 A1, which are incorporated herein by reference in their entirety. The immune cells expressing the CARs comprising these antigen binding domains can be generated and used for adoptive cellular therapy of cancer, infectious and immune disorders using methods known in the art and methods described in WO 2017/070608 A1, WO 2016/187349 A1, WO 2018/102795 A1, WO 2015/117229 A1, which are incorporated herein by reference in their entirety.

The disclosure further provides novel methods for generating allogeneic T cells expressing TCR and CARs, including next generation CARs (e.g., TFP, SIR, Ab-TCR, cTCR), for the purpose of off-the-shelf adoptive cellular therapy.

The disclosure further provides novel methods of combination therapies using autologous and allogeneic T cells expressing TCR and CARs, including next generation CARs (e.g., TFP, SIR, Ab-TCR and cTCR. The disclosure provides methods of restoring the expression and/or activity of TFPs based on CD3ε, CD3γ and CDδ chains in T cells lacking the expression of native TCRα, TCRβ, TCRγ or TCRδ chains by coexpressing in the cells expressing the TFPs the constant chains of TCRα, TCRβ, TCRγ or TCRδ. The disclosure further provides methods of restoring the expression and/or activity of TFPs based on CD3ε, CD3γ and CDδ chains in T cells lacking the expression of native TCRα, TCRβ, TCRγ or TCRδ chains by coexpressing in the cells expressing the TFPs either SIRs or Ab-TCR that encode the full length or fragments of constant chains of TCRα, TCRβ, TCRγ or TCRδ. The disclosure provides that TFPs based on CD3ε, CD3γ and CDδ chains can be combined with SIRs or Ab-TCR encoding the constant chains of TCRα, TCRβ, TCRγ or TCRδ constant chains in T cells lacking the native TCRα, TCRβ, TCRγ or TCRδ chains for the purpose of allogeneic and off-the-shelf therapy.

As used herein and in the appended claims, the singular forms "a," "an," and "the" include plural referents unless the context clearly dictates otherwise. Thus, for example, reference to "a cell" includes a plurality of such cells and reference to "the polynucleotide" includes reference to one or more polynucleotides and so forth.

Also, the use of "or" means "and/or" unless stated otherwise. Similarly, "comprise," "comprises," "comprising" "include," "includes," and "including" are interchangeable and not intended to be limiting.

It is to be further understood that where descriptions of various embodiments use the term "comprising," those skilled in the art would understand that in some specific instances, an embodiment can be alternatively described using language "consisting essentially of" or "consisting of."

Unless otherwise defined, all technical and scientific terms used herein have the same meaning as commonly understood by one of ordinary skill in the art to which this invention belongs. Allen et al., *Remington: The Science and Practice of Pharmacy* 22$^{nd}$ *ed.*, Pharmaceutical Press (Sep. 15, 2012); Hornyak et al., *Introduction to Nanoscience and Nanotechnology*, CRC Press (2008); Singleton and Sainsbury, *Dictionary of Microbiology and Molecular Biology* 3$^{rd}$ *ed., revised ed.*, J. Wiley & Sons (New York, NY 2006); Smith, *March's Advanced Organic Chemistry Reactions, Mechanisms and Structure* 7$^{th}$ *ed.*, J. Wiley & Sons (New York, NY 2013); Singleton, *Dictionary of DNA and Genome Technology* 3$^{rd}$ *ed.*, Wiley-Blackwell (Nov. 28, 2012); and Green and Sambrook, *Molecular Cloning: A Laboratory Manual* 4th *ed.*, Cold Spring Harbor Laboratory Press (Cold Spring Harbor, NY 2012), provide one skilled in the art with a general guide to many of the terms used in the present application. For references on how to prepare antibodies, see Greenfield, *Antibodies A Laboratory Manual* 2$^{nd}$ ed., Cold Spring Harbor Press (Cold Spring Harbor NY, 2013); Köhler and Milstein, *Derivation of specific antibody-producing tissue culture and tumor lines by cell fusion*, Eur. J. Immunol. 1976 Jul. 6(7):511-9; Queen and Selick, *Humanized immunoglobulins*, U.S. Pat. No. 5,585,089 (1996 December); and Riechmann et al., *Reshaping human antibodies for therapy*, Nature 1988 Mar. 24, 332(6162):323-7A11 headings and subheading provided herein are solely for ease of reading and should not be construed to limit the invention. Although methods and materials similar or equivalent to those described herein can be used in the practice or testing of the invention, suitable methods and materials are described below. All publications, patent applications, patents, and other references mentioned herein are incorporated by reference in their entirety. In case of conflict, the present specification, including definitions, will control. In addition, the materials, methods, and specific examples are illustrative only and not intended to be limiting.

All publications herein are incorporated by reference to the same extent as if each individual publication or patent application was specifically and individually indicated to be incorporated by reference. Any references cited are not an admission that any of the information provided therein is prior art or relevant to the presently claimed invention, or that any publication specifically or implicitly referenced is prior art.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods or describe the compositions herein. Moreover, any value or range (e.g., less than 20 or similar terminology) explicitly includes any integer between such values or up to the value. Thus, for example, "one to five mutations" explicitly includes 1, 2, 3, 4, and/or 5 mutations.

The term "Ab-TCR" or "AbTCR" refers to a next generation CAR platform as described in WO 2017/070608 A1 which is incorporated herein by reference. In an embodiment, an Ab-TCR comprises an antibody moiety that specifically binds to a target antigen fused to a TCR module capable of recruiting at least one TCR signaling module. Exemplary TCR modules that can be used in the construction of Ab-TCR are provided in SEQ ID NO: 959-964 (Table 6D) and in WO 2017/070608 A1 which is incorporated herein by reference. In the TCR module TCRb-IAH-6MD three amino acid residues (F133, E136 and Q139) found in human TCRb chain (SEQ ID NO: 15053) (see Tables 4, 5 & 6D) are mutated to the residues Isoleucine, Alanine, and Histidine found in the murine TCRb chain, respectively, so as to enhance the expression of this module. Similarly, in the TCR module IgG1-CH1-TCRa-SDVP-6MD four amino acid residues (P91, E92, S93, S94) found in human TCRα chain (SEQ ID NO: 15041) are mutated to the residues S, D, V, P found in the murine TCRα chain so as to enhance the expression of this module (see Tables 3 & 6D). Exemplary Ab-TCRs co-expressing an accessory module encoding NEMO-K277A are provided in SEQ ID NO: 3124-3523 (Table 14). However, the accessory module encoding NEMO-K277A is optional. Ab-TCR with the antigen binding domains (i.e., vL and vH fragments, ligands and receptors etc.) described in this disclosure can be constructed without NEMO-K277A. As such this accessory module along with the upstream Furine-SGSG-F2A sequence can be deleted from the Ab-TCR. Alternatively, the accessory module encoding NEMO-K277A can be replaced by accessory modules encoding other proteins, such as hNEMO-K277A-deltaV249-K555, mNEMO-K270A, K13-opt, IKK2-S177E-S181E, or IKK1-5176E-5180E, and MyD88-L265P, FKBPx2-NEMO, NEMO-L600-FKBPx2 etc. Furthermore, the TCR modules present in the Ab-TCR can be substituted by other TCR modules described in WO 2017/070608 A1. For example, the Ab-TCR represented by SEQ ID NO: 3124-3323 contain TCR modules IgCL-TCRb-IAH-6MD (SEQ ID NO: 960) and IgG1-CH1-TCRa-SDVP-6MD (SEQ ID NO: 963) which can be substituted by TCR modules IgCL-TCRb-wt2-opt-6MD (SEQ ID NO: 961) and IgG1-CH1-TCRa-wt2-opt-6MD (SEQ ID NO: 964), respectively. Exemplary Ab-TCRs co-expressing an accessory module encoding NEMO-K277A and containing the TCR modules IgCL-TCRg-6MD (SEQ ID NO: 959) and IgG1-CH1-TCRd-6MD (SEQ ID NO: 962) are provided in SEQ ID NO: 3324-3523. The order of the antigen binding domains in these constructs is the same as the order of the constructs shown in Table 14 and therefore a Ab-TCR based on IgCL-TCRg-6MD (SEQ ID NO: 959) and IgG1-CH1-TCRd-6MD (SEQ ID NO: 962) targeting a particular antigen and containing a specific antigen binding domain can be identified by referring to Table 14.

The term "accessory module" refers to any one or more of hNEMO-K277A (or NEMO-K277A), hNEMO-K277A-delta-V249-K555, mNEMO-K270A, K13-opt, IKK2-5177E-S181E (or IKK2-SS/EE), IKK1-5176E-5180E (or IKK1-SS/EE), MyD88-L265P, TCL-1a, MTCP-1, CMV-141, 41BBL, CD40OL, vFLIP-K13, MC159, cFLIP-L/MRITα, cFLIP-p22, HTLV1 Tax, HTLV2 Tax, HTLV2 Tax-RS mutant, FKBPx2-K13, FKBPx2-HTLV2-Tax, FKBPx2-HTLV2-Tax-RS, IL6R-304-vHH-Alb8-vHH, IL12f, PD1-4H1 scFV, PD1-5C4 scFV, PD1-4H1-A1b8-vHH, PD1-5C4-A1b8-vHH, CTLA4-Ipilimumab-scFv, CTLA4-Ipilimumab-Alb8-vHH, IL6-19A-scFV, IL6-19A-scFV-A1b8-vHH, sHVEM, sHVEM-Alb8-vHH, hTERT, Fx06, shRNA targeting Brd4, IgSP-[TRAC-opt2], IgSP-R [TRBC-opt2] and combination thereof that is expressed in an immune cell (e.g., T cell, e.g., CAR-T cell or TCR-T cell) to decrease, regulate or modify the activity of the immune cell. In some embodiments, the accessory module is co-expressed with an immune receptor such as a CAR or a TCR to increase, decrease, regulate or modify the expression or activity of a CAR or a TCR or a CAR-expressing or a TCR-expressing cell. The accessory module can be co-expressed with a CAR or a TCR using a single vector or using two or more different vectors. In a further embodiment, the accessory module comprises an FKBP (FK506 binding protein)-fusion protein, such as FKBPx2-NEMO, whose activity can be controlled by the administration of a dimerizer molecule. In some embodiments, the accessory module is expressed in an antigen presenting cell, e.g., a dendritic cell.

As used herein "affinity" is meant to describe a measure of binding strength. Affinity, in some instances, depends on the closeness of stereochemical fit between a binding agent and its target (e.g., between an antibody and antigen including epitopes specific for the binding domain), on the size of the area of contact between them, and on the distribution of charged and hydrophobic groups. Affinity generally refers to the "ability" of the binding agent to bind its target. There are numerous ways used in the art to measure "affinity". For example, methods for calculating the affinity of an antibody for an antigen are known in the art, including use of binding experiments to calculate affinity. Binding affinity may be determined using various techniques known in the art, for example, surface plasmon resonance, bio-layer interferometry, dual polarization interferometry, static light scattering, dynamic light scattering, isothermal titration calorimetry, ELISA, analytical ultracentrifugation, and flow cytometry. An exemplary method for determining binding affinity employs surface plasmon resonance. Surface plasmon resonance is an optical phenomenon that allows for the analysis of real-time biospecific interactions by detection of alterations in protein concentrations within a biosensor matrix, for example using the BIAcore system (Pharmacia Biosensor AB, Uppsala, Sweden and Piscataway, N.J.). As used herein, the term "specific binding" means the contact between an antibody and an antigen with a binding affinity of at least $10^{-6}$ M. In certain aspects, antibodies bind with affinities of at least about 10'M, and preferably $10^{-8}$ M, $10^{-9}$ M, $10^{-10}$ $10^{-11}$M, or $10^{-12}$M.

The "AKT Pathway" or "PI3K-AKT Pathway" as used herein is a signal transduction pathway that promotes survival and growth in response to extracellular signals. Key proteins involved are PI3K (phosphatidylinositol 3-kinase) and Akt (Protein Kinase B).

The term "antibody," as used herein, refers to a protein, or polypeptide sequence derived from an immunoglobulin molecule which specifically binds with an antigen. Antibodies can be monoclonal, or polyclonal, multiple or single chain, or intact immunoglobulins, and may be derived from natural sources or from recombinant sources. Antibodies can be tetramers of immunoglobulin molecules. The antibody may be 'humanized', 'chimeric' or non-human.

The term "antibody fragment" refers to at least one portion of an antibody, that retains the ability to specifically interact with (e.g., by binding, steric hindrance, stabilizing/destabilizing, spatial distribution) an epitope of an antigen. Examples of antibody fragments include, but are not limited to, Fab, Fab', F(ab'h, Fv fragments, scFv antibody fragments, disulfide-linked Fvs (sdFv), a Fd fragment consisting of the VH and CH1 domains, linear antibodies, single domain antibodies (sdAb) such as either vL or vH, camelid vHH domains, multi-specific antibodies formed from antibody fragments such as a bivalent fragment comprising two Fab fragments linked by a disulfide bridge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3) (see U.S. Pat. No. 6,703,199, which describes fibronectin polypeptide mini-bodies).

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

"Anticancer agent" refers to agents that inhibit aberrant cellular division and growth, inhibit migration of neoplastic cells, inhibit invasiveness or prevent cancer growth and metastasis. The term includes chemotherapeutic agents, biological agent (e.g., siRNA, viral vectors such as engineered MLV, adenoviruses, herpes virus that deliver cytotoxic genes), antibodies and the like.

The term "anticancer effect" refers to a biological effect which can be manifested by various means, including but not limited to, a decrease in tumor volume, a decrease in the number of cancer cells, a decrease in the number of metastases, an increase in life expectancy, decrease in cancer cell proliferation, decrease in cancer cell survival, or amelioration of various physiological symptoms associated with the cancerous condition. An "anticancer effect" can also be manifested by the ability of the CARs in prevention of the occurrence of cancer in the first place.

The term "antigen" or "Ag" refers to a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. The disclosure includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample, or might be macromolecule besides a polypeptide. Such a biological sample can include, but is not limited to a tissue sample, a tumor sample, a cell or a fluid with other biological components.

Non-limiting examples of target antigens include: CD5; CD19; CD123; CD22; CD30; CD171; CS1 (also referred to as CD2 subset 1, CRACC, MPL, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bDGalp(1-4)bDGlcp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); sialyl Lewis adhesion molecule (sLe); ganglioside GM3 (aNeu5Ac(2-3)bDClalp(1-4)bDG1cp(1-1) Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRCSD); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; survivin; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin Bl; v-myc avian myelocytomatosis viral oncogene neuroblastoma derived homolog (MYCN); Ras Homolog Family Member C (RhoC); Tyrosinase-related protein 2 (TRP-2); Cytochrome P4501B 1 (CYP1B 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GM1, PTK7, gpNMB, CDH1-CD324, DLL3, CD276/B7H3, IL11Ra, IL13Ra2, CD179b-IGL11, TCRgamma-delta, NKG2D, CD32 (FCGR2A), Tn ag, Tim1-/HVCR1, CSF2RA (GM-CSFR-alpha), TGFbetaR2, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Gonadotropin Hormone receptor (CGHR or GR), CCR4, GD3, SLAMF6, SLAMF4, HIV1 envelope glycoprotein, HTLV1-Tax, CMV pp65, EBV-EBNA3c, KSHV K8.1, KSHV-gH, influenza A hemagglutinin (HA), GAD, PDL1, Guanylyl cyclase C (GCC), auto antibody to desmoglein 3 (Dsg3), auto antibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IgE, CD99, Ras G12V, Tissue Factor 1 (TF1), AFP, GPRCSD, Claudin18.2 (CLD18A2 or CLDN18A.2), P-glycoprotein, STEAP1, Liv1, Nectin-4, Cripto, gpA33, BST1/CD157, low conductance chloride channel, and the antigen recognized by TNT antibody.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

The term "anti-infection effect" refers to a biological effect which can be manifested by various means, including but not limited to, e.g., decrease in the titer of the infectious agent, a decrease in colony counts of the infectious agent, amelioration of various physiological symptoms associated with the infectious condition. An "anti-infectious effect" can also be manifested by the ability of the peptides, polynucleotides, cells and antibodies in prevention of the occurrence of infection in the first place.

The term "antitumor effect" or "anti-cancer effect" refers to a biological effect which can be manifested by various means, including but not limited to, e.g., a decrease in tumor volume, a decrease in the number of tumor cells, a decrease in tumor cell proliferation, or a decrease in tumor cell survival.

An "antigen binding domain" or "antigen binding module" or "antigen binding segment" or "antigen specific domain" (ASD) refers to a polypeptide or peptide that due to its primary, secondary or tertiary sequence, post-translational modifications and/or charge binds to an antigen with a high degree of specificity. The antigen binding domain may be derived from different sources, for example, an antibody (full length heavy chain, Fab fragments, single chain Fv (scFv) fragments, divalent single chain antibodies or diabodies), a non-immunoglobulin binding protein, a ligand or a receptor. There are, however, numerous alternatives, such as linked cytokines (which leads to recognition of cells bearing the cytokine receptor), affibodies, ligand binding domains from naturally occurring receptors, soluble protein/peptide ligand for a receptor (for example on a tumor cell), peptides, and vaccines to prompt an immune response, which may each be used in various embodiments of the invention. In some embodiments, almost any molecule that binds a given antigen with high affinity can be used as an ASD, as will be appreciated by those of skill in the art. In some embodiments, the antigen binding domain comprises T cell receptors (TCRs) or portions thereof. In exemplary embodiments, nucleic acids encoding antigen binding domains comprising scFVs are set forth herein in SEQ ID NOs: 642-902 and in Table 6C. In exemplary embodiments, amino acids encoding antigen binding domains comprising scFVs are set forth herein in SEQ ID NOs: 4555-4815 in Table 6C.

The term "Association constant (Ka)" is defined as the equilibrium constant of the association of a receptor and ligand.

"Autoantibody" refers to an antibody that is produced by a B-cell specific for an autoantigen.

The term "autoantigen" refers to an endogenous antigen that stimulates production of an autoimmune response, such as production of autoantibodies. Autoantigen also includes a self-antigen or antigen from a normal tissue that is the target of a cell mediated or an antibody-mediated immune response that may result in the development of an autoimmune disease. Examples of autoantigens include, but are not limited to, desmoglein 1, desmoglein 3, and fragments thereof.

"Avidity" refers to the strength of the interaction between a binding agent and its target (e.g., the strength of the interaction between an antibody and its antigen target, a receptor and its cognate and the like). The avidity can be weak or strong. Methods for calculating the affinity of an antibody for an antigen are known in the art, including use of binding experiments to calculate affinity. Antibody activity in functional assays (e.g., flow cytometry assay) is also reflective of antibody affinity. Antibodies and affinities can be phenotypically characterized and compared using functional assays (e.g., flow cytometry assay).

As used herein, the term "backbone" refers to the specific combination of CARs (Table 1) and accessory modules as described in Table 2. In exemplary embodiments, specific combinations of CARs and accessory modules which comprise various backbones are described in Table 2. In one embodiment, the CAR and the accessory module are encoded by a single nucleic acid molecule. In another embodiment, the CAR is encoded by the first nucleic acid molecule and the accessory module is encoded by a second nucleic acid molecule. In some embodiments, the accessory module is encoded by more than one nucleic acid molecule, depending on the number of components in the accessory modules.

As used herein "beneficial results" may include, but are in no way limited to, lessening or alleviating the severity of the disease condition, preventing the disease condition from worsening, curing the disease condition, preventing the disease condition from developing, lowering the chances of a patient developing the disease condition and prolonging a patient's life or life expectancy. As non-limiting examples, "beneficial results" or "desired results" may be alleviation of one or more symptom(s), diminishment of extent of the deficit, stabilized (i.e., not worsening) state of cancer progression, delay or slowing of metastasis or invasiveness, and amelioration or palliation of symptoms associated with the cancer.

As used herein, the term "binding domain" or "antibody molecule" refers to a protein, e.g., an immunoglobulin chain or fragment thereof, ligand domain or fragment thereof (as the case may be), comprising at least one domain, e.g., immunoglobulin variable domain sequence that can bind to a target with affinity higher than a non-specific domain. The term encompasses antibodies and antibody fragments, or ligands and ligand fragments. In another embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In another embodiment, a multispecific antibody molecule is a bispecific antibody molecule. A bispecific antibody has specificity for two antigens. A bispecific antibody molecule is characterized by a first immunoglobulin variable domain sequence which has binding specificity for a first epitope and a second immunoglobulin variable domain sequence that has binding specificity for a second epitope. A bispecific molecule may be a bispecific T cell engaging antibody in which first antigen binding domain binds to an antigen (e.g., CD3c) expressed on T cells and the second antigen binding domain binds to an antigen expressed on a disease causing or disease associated cell (e.g., a cancer cell). The bispecific antibodies can be used for inducing T cell mediated cytotoxicity against cells expressing the target antigen recognized by their second antigen binding domain. The antigen binding domains described in this disclosure can be used to construct bispecific T cell engagers. The nucleic acid sequences of exemplary bispecific T cell engagers comprising the antigen binding domains (e.g. scFv) described in this disclosure are presented in SEQ ID NO: 3545-3830 (Table 13). The corresponding amino acid sequences are presented in SEQ ID NO: 7458-7721.

"Binds the same epitope as" means the ability of an antibody, scFv, or other antigen binding domain to bind to a target antigen and having the same epitope as an exemplified antibody, scFv, or other antigen binding domain. As an example, the epitopes of the exemplified antibody, scFv, or other binding agent and other antibodies can be determined using standard epitope mapping techniques. Epitope mapping techniques, well known in the art include Epitope Mapping Protocols in Methods in Molecular Biology, Vol. 66 (Glenn E. Morris, Ed., 1996) Humana Press, Totowa, New Jersey. For example, linear epitopes may be determined by, e.g., concurrently synthesizing large numbers of peptides on solid supports, the peptides corresponding to portions of the protein molecule, and reacting the peptides with anti-bodies while the peptides are still attached to the supports. Such techniques are known in the art and described in, e.g., U.S. Pat. No. 4,708,871; Geysen et al, (1984) Proc. Natl. Acad. Sci. USA 8:3998-4002; Geysen et al, (1985) Proc. Natl. Acad. Sci. USA 82:78-182; Geysen et al, (1986) Mol. Immunol. 23: 709-715. The epitope bound by the antigen binding domain of a CAR can be also determined by the Epitope Binning assay. Epitope binning is a competitive immunoassay used to characterize and then sort a library of monoclonal antibodies against a target protein. Antibodies against a similar target are tested against all other antibodies in the library in a pairwise fashion to see if antibodies block one another's binding to the epitope of an antigen. After each antibody has a profile created against all of the other antibodies in the library, a competitive blocking profile is created for each antibody relative to the others in the library. Closely related binning profiles indicate that the antibodies have the same or a closely related epitope and are "binned" together. Similarly, conformational epitopes are readily identified by determining spatial conformation of amino acids such as by, e.g., hydrogen/deuterium exchange, x-ray crystallography and two-dimensional nuclear magnetic resonance. See, e.g., Epitope Mapping Protocols, supra. Antigenic regions of proteins can also be identified using standard antigenicity and hydropathy plots, such as those calculated using, e.g., the Omiga version 1.0 software program available from the Oxford Molecular Group. This computer program employs the Hopp/Woods method, Hopp et al, (1981) Proc. Natl. Acad. Sci USA 78:3824-3828; for determining antigenicity profiles, and the Kyte-Doolittle technique, Kyte et al, (1982) J. Mol. Bioi. 157: 105-132; for hydropathy plots. To determine if selected monoclonal antibodies against a target (e.g., CD19) bind to unique epitopes, each antibody can be biotinylated using commercially available reagents (Pierce, Rockford, Ill.). Competition studies using unlabeled monoclonal antibodies and biotinylated monoclonal antibodies can be performed using CD19-extracellular domain coated-ELISA plates. Biotinylated mAb binding can be detected with a strep-avidin-alkaline phosphatase probe. Exemplary epitopes of human CD20 antigen bound by scFv and CARs of the current disclosure are provided in SEQ ID NO: 15149-15154. Exemplary epitopes of human BCMA bound by scFv and CARs of the current disclosure are provided in SEQ ID NO: 15155-15159. An exemplary epitope of human MPL antigen bound by scFv and CARs of the current disclosure is provided in SEQ ID NO: 15160.

As used herein, the term "biological equivalent thereof" is intended to be synonymous with "equivalent thereof" when referring to a reference protein, antibody or fragment thereof, polypeptide or nucleic acid, intends those having minimal homology while still maintaining desired structure or functionality. Unless specifically recited herein, it is contemplated that any of the above also includes equivalents thereof. For example, an equivalent intends at least about 70% homology or identity, or at least 80% homology or identity and alternatively, or at least about 85%, or alternatively at least about 90%, or alternatively at least about 95%, or alternatively at least 98% percent homology or identity and exhibits substantially equivalent biological activity to the reference protein, polypeptide, antibody or fragment thereof or nucleic acid. Alternatively, when referring to polynucleotides, an equivalent thereof is a polynucleotide that hybridizes under stringent conditions to the reference polynucleotide or its complement. Alternatively, when referring to polypeptides or proteins, an equivalent thereof is an expressed polypeptide or protein from a polynucleotide that hybridizes under stringent conditions to the polynucleotide or its complement that encodes the reference polypeptide or protein.

As used herein, the term "CDR" or "complementarity determining region" is intended to mean the non-contiguous antigen combining sites found within the variable region of both heavy and light chain polypeptides. These particular regions have been described by Kabat et al., J. Bioi. Chem. 252:6609-6616 (1977); Kabat et al., U.S. Dept. of Health and Human Services, "Sequences of proteins of immunological interest" (1991); Chothia et al., J. Mol. Bioi. 196: 901-917 (1987); and MacCallum et al., J. Mol. Bioi. 25 262:732-745 (1996), where the definitions include overlapping or subsets of amino acid residues when compared against each other. Nevertheless, application of either definition to refer to a CDR of an antibody or grafted antibodies or variants thereof is intended to be within the scope of the term as defined and used herein. As used herein, the different CDRs of an antibody could be also defined by a combination of the different definitions. For example, vHCDR1 could be defined based on Kabat and VHCDR2 could be defined based on Chothia. The amino acid residues which encompass the CDRs as defined by each of the above cited references are as follows:

| | CDR DEFINITIONS | | |
|---|---|---|---|
| | Kabat | Chothia | MacCallum |
| VHCDR1 | 31-35 | 26-32 | 30-35 |
| VHCDR2 | 50-65 | 53-55 | 47-58 |
| VHCDR3 | 95-102 | 96-10 | 193-101 |
| VLCDR1 | 24-34 | 26-32 | 30-36 |
| VLCDR2 | 50-56 | 50-52 | 46-55 |
| VLCDR3 | 89-97 | 91-96 | 89-96 |

(Residue Numbers correspond to the identified reference).

The SEQ IDs of the CDRs of the different vL and vH segments that can make up antigen binding domains of CARs of the disclosure are provided in SEQ ID NO: 13204-14121 and SEQ ID NO: 14122-15039, respectively (Tables 6A, B) and in Tables 5-6 in PCT/US2017/064379, which are incorporated herein by reference.

In some embodiments, reference to an antigen-binding module (such as a Fab-like or Fv-like antigen-binding module) that specifically binds to a target antigen means that the antigen-binding module binds to the target antigen with (a) an affinity that is at least about 10 (e.g., about 10, 20, 30, 40, 50, 75, 100, 200, 300, 400, 500, 750, 1000 or more) times its binding affinity for other molecules; or (b) a $K_d$ no more than about $\frac{1}{10}$ (e.g., $\frac{1}{10}$, $\frac{1}{20}$, $\frac{1}{30}$, $\frac{1}{40}$, $\frac{1}{50}$, 1175, $\frac{1}{100}$, $\frac{1}{200}$, $\frac{1}{300}$, $\frac{1}{400}$, $\frac{1}{500}$, $\frac{1}{750}$, $\frac{1}{1000}$ or less) times its $K_d$ for binding to other molecules. Binding affinity can be determined by methods known in the art, such as ELISA, fluorescence activated cell sorting (FACS) analysis, or radioimmunoprecipitation assay (RIA). $K_d$ can be determined by methods known in the art, such as surface plasmon resonance (SPR) assay utilizing, for example, Biacore instruments, or kinetic exclusion assay (KinExA) utilizing, for example, Sapidyne instruments.

"Cancer" and "cancerous" refer to or describe the physiological condition in mammals that is typically characterized by unregulated cell growth. Examples of cancer include, but are not limited to B-cell lymphomas (Hodgkin's lymphomas and/or non-Hodgkins lymphomas), T cell lymphomas, myeloma, myelodysplastic syndrome, skin cancer, brain tumor, breast cancer, colon cancer, rectal cancer, esophageal cancer, anal cancer, cancer of unknown primary site, endocrine cancer, testicular cancer, lung cancer, hepatocellular cancer, gastric cancer, pancreatic cancer, cervical cancer, ovarian cancer, liver cancer, bladder cancer, cancer of the urinary tract, cancer of reproductive organs thyroid cancer, renal cancer, carcinoma, melanoma, head and neck cancer, brain cancer (e.g., glioblastoma multiforme), prostate cancer, including but not limited to androgen-dependent prostate cancer and androgen-independent prostate cancer, and leukemia. Other cancer and cell proliferative disorders will be readily recognized in the art. The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors. The term "cancer" is meant to include all types of cancerous growths or oncogenic processes, metastatic tissues or malignantly transformed cells, tissues, or organs, irrespective of histopathologic type or stage of invasiveness. Exemplary solid tumors include malignancies, e.g., adenocarcinomas, sarcomas, and carcinomas, of the various organ systems, such as those affecting breast, liver, lung, brain, lymphoid, gastrointestinal (e.g., colon), genitourinary tract (e.g., renal, urothelial cells), prostate and pharynx. Adenocarcinomas include cancers such as most colon cancers, rectal cancer, renal-cell carcinoma, liver cancer, non-small cell carcinoma of the lung, cancer of the small intestine and cancer of the esophagus. In one embodiment, the cancer is a melanoma, e.g., an advanced stage melanoma. Metastatic lesions of the aforementioned cancers can also be treated or prevented using the methods and compositions of the disclosure. Examples of other cancers that can be treated or prevented include pancreatic cancer, bone cancer, skin cancer, cutaneous or intraocular malignant melanoma, uterine cancer, ovarian cancer, rectal cancer, cancer of the head or neck, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin Disease, non-Hodgkin lymphoma, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, chronic or acute leukemias including acute myeloid leukemia, chronic myeloid leukemia, acute lymphoblastic leukemia, chronic lymphocytic leukemia, solid tumors of childhood, lymphocytic lymphoma, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers including those induced by asbestos, and combinations of said cancers. Treatment of metastatic cancers, e.g., metastatic cancers that express PD-L1 (Iwai et al. (2005) Int. Immunol. 17:133-144) can be effected using the antibody molecules described herein. Exemplary cancers whose growth can be inhibited include cancers typically responsive to immunotherapy. Additionally, recurrent or are refractory malignancies can be treated using the molecules described herein.

"Chemotherapeutic agents" are compounds that are known to be of use in chemotherapy for cancer. Non-limiting examples of chemotherapeutic agents can include alkylating agents such as thiotepa and CYTOXAN® cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; antibiotics such as the enediyne antibiotics (e.g., calicheamicin, especially calicheamicin gamma1I and calicheamicin omega1I (see, e.g., Agnew, Chem. Intl. Ed. Engl., 33: 183-186 (1994)); dynemicin, including dynemicin A; bisphosphonates, such as clodronate; an esperamicin; as well as neocarzinostatin chromophore and related chromoprotein enediyne antiobiotic chromophores), aclacinomysins, actinomycin, authramycin, azaserine, bleomycins, cactinomycin, carabicin, caminomycin, carzinophilin, chromomycinis, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate;

hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL® paclitaxel (Bristol-Myers Squibb Oncology, Princeton, N.J.), ABRAXANE® Cremophor-free, albumin-engineered nanoparticle formulation of paclitaxel (American Pharmaceutical Partners, Schaumberg, Ill.), and TAXOTERE® doxetaxel (Rhone-Poulenc Rorer, Antony, France); chloranbucil; GEMZAR® gemcitabine; 6-thioguanine; mercaptopurine; methotrexate; platinum analogs such as cisplatin, oxaliplatin and carboplatin; vinblastine; platinum; etoposide (VP-16); ifosfamide; mitoxantrone; vincristine; NAVELBINE; vinorelbine; novantrone; teniposide; edatrexate; daunomycin; aminopterin; xeloda; ibandronate; irinotecan (Camptosar, CPT-11) (including the treatment regimen of irinotecan with 5-FU and leucovorin); topoisomerase inhibitor RFS 2000; difluoromethylornithine (DMFO); retinoids such as retinoic acid; capecitabine; combretastatin; leucovorin (LV); oxaliplatin, including the oxaliplatin treatment regimen (FOLFOX); lapatinib (Tykerb); inhibitors of PKC-alpha, Raf, H-Ras, EGFR (e.g., erlotinib (Tarceva®)) and VEGF-A that reduce cell proliferation and pharmaceutically acceptable salts, acids or derivatives of any of the above or combinations thereof "Chimeric antigen receptors" (CARs) are artificial (non-naturally occurring) immune cell (e.g., T cell) receptors contemplated for use as a therapy for cancer, using a technique called adoptive cell transfer. CARs are also known as artificial T-cell receptors, chimeric T-cell receptors or chimeric immunoreceptors. The antigen-binding, signaling, and stimulatory functions of the complex have been manipulated by genetic recombination methods to a single polypeptide chain, generally referred to as a Chimeric Antigen Receptor (CAR). See, e.g., Eshhar, U.S. Pat. No. 7,741, 465; Eshhar, U.S. Patent Application Publication No. 2012/ 0093842. CARs are constructed specifically to stimulate T cell activation and proliferation in response to a specific antigen to which the CAR binds. Generally, a CAR refers to a set of polypeptides, typically two in the simplest embodiments, which when expressed in an immune effector cell, provides the cell with specificity for a target cell, typically a cancer cell, and with intracellular signal generation. In some embodiments, a CAR comprises at least an extracellular antigen binding domain, a transmembrane domain and a cytoplasmic signaling domain (also referred to herein as "an intracellular signaling domain") comprising a functional signaling domain derived from a stimulatory molecule and/ or costimulatory molecule. In some aspects, the set of polypeptides are contiguous with each other. In one aspect, the stimulatory molecule is the zeta chain associated with the T cell receptor complex. In one aspect, the cytoplasmic signaling domain further comprises one or more functional signaling domains derived from at least one costimulatory molecule as defined below. In one embodiment, the costimulatory molecule is chosen from the costimulatory molecules described herein, e.g., 4-1BB (i.e., CD137), CD27 and/or CD28. In one embodiment, the CAR comprises an optional leader sequence at the amino-terminus (N-ter) of the CAR fusion protein. In one embodiment, the CAR further comprises a leader sequence at the N-terminus of the extracellular antigen binding domain, wherein the leader sequence is optionally cleaved from the antigen binding domain (e.g., a scFv) during cellular processing and localization of the CAR to the cellular membrane. In various embodiments, CARs are recombinant polypeptides comprising an antigen-specific domain (ASD), a hinge region (HR), a transmembrane domain (TMD), an optional co-stimulatory domain (CSD) and an intracellular signaling domain (ISD). The optional costimulatory domain is generally absent in the 1$^{st}$ generation CAR constructs. The target antigen, antigen binding domain name and nucleic acid sequences of several exemplary 1$^{st}$ generation CARs comprising the different antigen binding domains (e.g., vL and vH fragments, vHH, ligands and receptors etc.) described in this disclosure and coexpressing the accessory modules encoding NEMO-K277A and PAC are presented in SEQ ID NO: 1594-1899 (Tables 12). These CAR constructs carry a human CD8 signal peptide, a CD8 hinge and transmembrane region and human CD3 intracellular signaling domain. These constructs also carry a MYC linker between the antigen binding domain and the CD8 hinge region, which is optional. The nucleic acid sequences of several exemplary 1$^{st}$ generation CARs comprising the different antigen binding domains (e.g., vL and vH fragments, vHH, ligands and receptors etc.) described in this disclosure and coexpressing the accessory modules encoding vFLIP K13 and PAC are presented in SEQ ID NO: 1016-1317 (Table 13). The nucleic acid sequences of several exemplary 2nd generation CARs comprising the different antigen binding domains (e.g., vL and vH fragments, vHH, ligands and receptors etc.) described in this disclosure and incorporating the 41BB costimulatory domain are presented in SEQ ID NO: 1318-1593 (Table 13). These CAR constructs also carry a MYC linker between the antigen binding domain and the transmembrane domain and an accessory module encoding puromycin resistance gene (PAC) that is separated from the CAR cassette by a Furine-SGSG-T2A sequence. The accessory module encoding vFLIP-K13, NEMO-K277A and PAC are optional in the above described 1$^{st}$ and 2$^{nd}$ generation CARs. Thus, CARs with the antigen binding domains (i.e., vL and vH fragments, vHH, ligands and receptors etc.) described in this disclosure can be constructed without vFLIP-K13, NEMO-K277A and/or PAC. As such, these accessory modules along with the upstream cleavage linker sequences (e.g., F2A, P2A, or T2A) can be deleted from the CARs represented by SEQ ID NO: 1016-1899. Alternatively, the accessory module encoding vFLIP-K13, NEMO-K277A and/or PAC can be replaced by accessory modules encoding other proteins, such as hNEMO-K277A-deltaV249-K555, mNEMO-K270A, K13-opt, IKK2-S177E-S181E, or IKK1-5176E-5180E, and MyD88-L265P, FKBPx2-NEMO, NEMO-L600-FKBPx2, TCL-1A, MTCP-1, and CMV-141 etc. As used herein, the term "CAR" or "CARs" also encompasses newer approaches to conferring antigen specificity onto cells, such as Antibody-TCR chimeric molecules or Ab-TCR or Ab-TCR (WO 2017/070608 A1 incorporated herein by reference), TCR receptor fusion proteins or TFP (WO 2016/ 187349 A1 incorporated herein by reference), Synthetic Immune Receptors (SIRs) (see, WO 2018/102795 A1, incorporated herein by reference), Tri-functional T cell antigen coupler (Tri-TAC) (see, WO 2015/117229 A1, incorporated herein by reference). The nucleic acid sequences of several exemplary TFPs comprising the different antigen binding domains (e.g., vL and vH fragments, vHH, ligands and receptors etc.) described in this disclosure and based on CD3ε, CD3δ, CD3γ and CD3ζ chains and co-expressing the optional accessory module NEMO-K277A are presented in SEQ ID NO:1900-2205, 2206-2511, 2512-2817, 2818-3123, respectively (Table 13). The order of the antigen binding domains contained in the construct of different CAR architectures and BiTE listed in Table 13 is the same as the order of the constructs on the zCAR-K277A architecture presented in Table 12. Thus, the amino acid and nucleic acid SEQ ID NO of a CAR belonging to a given architecture (e.g., zCAR-K13) and containing a specific antigen binding domain can be determined by examination of Tables 12 and Table 13. Thus, Table 12 shows that a CAR on the zCAR-NEMO-K277A architecture and containing the huFMC63-11-(vL-vH) antigen binding domain is the 2nd construct in the Table 12 and is represented by nucleic acid and amino acid SEQ ID NOs: 1595 and 5508, respectively. The nucleic acid and amino acid SEQ ID Nos of a corresponding CAR on the zCAR-K13 architecture can be determine by examination of Table 13 which shows that the 2nd construct on this architecture has the nucleic acid and amino acid SEQ ID NOs: 1017 and 4930, respectively. A similar approach can be used to determine the nucleic acid and amino acid SEQ ID Nos of other CAR constructs belonging to different architectures and BiTEs. Table 10 provides the nucleic acid and amino acid SEQ ID Nos of several exemplary CARs belonging to different backbones and targeting HIV-1 Envelop Glycoprotein based on HIV1-N49P6 vL and vH antigen binding domains. Table 11 provides the nucleic acid and amino acid SEQ ID Nos of several exemplary CARs belonging to the backbones shown in Table 10 but containing different antigen binding domains. Thus, the nucleic acid and amino acid SEQ ID Nos of a CAR on a particular backbone containing the antigen binding domain shown in Table 11 can be determined by first determining its rank order in the Table 10. Thus, since the 1st generation CAR containing the vFLIP-K13 backbone is the third CAR on the list in Table 10, the nucleic acid SEQ ID NO of a $1^{st}$ generation CAR co-expressing vFLIP-K13 and containing the HIV1-N49P7 antigen binding domain can be easily determined from Table 11 to be the SEQ ID NO: 8740 (i.e., the $3^{rd}$ construct in the series starting at 8738). Using a similar approach, the amino acid SEQ ID NO of this CAR construct is determined to be SEQ ID NO: 11438. As the CARs are modular in design, the nucleic acid and amino acid sequence of a CAR/BiTE containing different antigen binding domains or accessory modules can be easily determined by person with ordinary skill in the art by using the sequence of the different modules and exemplary CAR and BiTE constructs disclosed in this disclosure. Typically, "CAR-T cells" are used, which refer to T-cells that have been engineered to express a chimeric antigen receptor. Thus, T lymphocytes bearing such CARs are generally referred to as CAR-T lymphocytes. CARs can be also expressed in cells other than T cells, such as hematopoietic stem cells, induced pluripotent stem cells (iPSC), NK cells and macrophage.

"Codon optimization" or "controlling for species codon bias" refers to the preferred codon usage of a particular host cell. As will be understood by those of skill in the art, it can be advantageous to modify a coding sequence to enhance its expression in a particular host. The genetic code is redundant with 64 possible codons, but most organisms typically use a subset of these codons. The codons that are utilized most often in a species are called optimal codons, and those not utilized very often are classified as rare or low-usage codons.

Optimized coding sequences containing codons preferred by a particular prokaryotic or eukaryotic host (see also, Murray et al. (1989) Nucl. Acids Res. 17:477-508) can be prepared, for example, to increase the rate of translation or to produce recombinant RNA transcripts having desirable properties, such as a longer half-life, as compared with transcripts produced from a non-optimized sequence. Translation stop codons can also be modified to reflect host preference. Those of skill in the art will recognize that, due to the degenerate nature of the genetic code, a variety of DNA compounds differing in their nucleotide sequences can be used to encode a given polypeptide of the disclosure.

As used herein, "co-express" refers to expression of two or more polynucleotides or genes. Genes may be nucleic acids encoding, for example, a single protein or a chimeric protein as a single polypeptide chain. A CAR or a TCR described herein may be encoded by a single polynucleotide chain and expressed as single polypeptide chain, which is subsequently cleaved into different polypeptides, each representing a distinct functional unit. In some embodiments, where the CAR or a TCR consists of two or more functional polypeptide units, the different functional units are coexpressed using one or more polynucleotide chains. In one embodiment, costimulation is provided by an accessory module that is co-expressed with the CAR or a TCR but is not an integral part of the CAR or TCR polypeptide. Such an accessory module that provides costimulation to a CAR- or TCR-expressing cell or any cell but is not an integral part of the CAR or the TCR polypeptide is termed a CAR independent costimulatory module or CICM. In another embodiment, the different polynucleotide chains are linked by nucleic acid sequences that encode for cleavable linkers (e.g. T2A, F2A, P2A, E2A etc.) (Table 6D). In another embodiment, a Ser-Gly-Ser-Gly (SGSG) motif (SEQ ID NO: 4844) is also added upstream of the cleavable linker sequences to enhance the efficiency of cleavage. The polynucleotides encoding the different units of a CAR or a TCR may be linked by IRES (Internal Ribosomal Entry Site) sequences. Alternately, the different functional units of a CAR or TCR are encoded by two different polynucleotides that are not linked via a linker but are instead encoded by, for example, two different vectors. The nucleic acid and amino acid sequences of exemplary cleavable linkers and Furine cleavage sites are provided in Table 6D.

A "conservative substitution" or "conservative sequence modifications" refers to amino acid modifications that do not significantly affect or alter the binding characteristics or function of the encoded protein. For example, "conservative sequence modifications" refers to amino acid modifications that do not significantly affect or alter the binding characteristics or function of a CAR contruct of the disclosure (e.g., a conservative change in the constant chain, antibody, antibody fragment, or non-immunoglobulin binding domains). Such conservative modifications include amino acid substitutions, additions and deletions. Modifications can be introduced by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR of the disclosure can be replaced with other amino acid residues from the same side chain family and the altered CAR can be tested using the binding and/or functional assays described herein.

The term "constant region of T cell receptor-alpha" or "constant chain of T cell receptor-alpha" or "TCRα" or "Cα" is defined as the protein provided as SEQ ID NO: 15041 or the equivalent residues (i.e., a homolog) from a non-human species, e.g., mouse, rodent, monkey, ape and the like. The disclosure also provides certain mutations to TCRα polypeptides which can be used in the construction of SIRs and Ab-TCR (Tables 3 and 6D). For example, sites of mutation in Cα that demonstrate increased expression and decreased mispairing are located at positions 91, 92, 93, and 94 of SEQ ID NO 15041. A TCR polypeptide with a Thr 48 Cys (T48C) mutation in Cα and a Ser-57-Cys (S57C) mutation in Cβ1 or Cβ2 chain (described more fully elsewhere herein) results in an additional disulfide bond between the two TCR constant chains (α and β). This, in turn, results in reduced mispairing with endogenous TCR chains in an immune cell and enhanced functionality. Similarly, a CAR with a Ser 61 Arg (S61R) mutation in Cα (SEQ ID NO:15048) and an Arg 79 Gly (R79G) mutation in Cβ1 or Cβ2 chain (described more fully elsewhere herein) results in reduced mispairing with the endogenous TCR chains and enhanced functionality due to a "knob and hole" design for pairing. The disclosure provides Cα polypeptides having one or more or all of the mutations according to Table 3 below which can be used in the construction of SIRs and Ab-TCR.

TABLE 3

Mutations according to the disclosure in
the human constant TCR-alpha region (Cα)

| Position (SEQ ID NO: 15041) | Amino acid in wild-type | Mutation | TYPE |
| --- | --- | --- | --- |
| 10 | Y | C | disulfide bond |
| 15 | S | C | disulfide bond |
| 45 | T | C | disulfide bond |
| 48 | T | C | disulfide bond |
| 61 | S | R | Knob into Hole |
| 91 | P | S | Murinization |
| 92 | E | D | Murinization |
| 93 | S | V | Murinization |
| 94 | S | P | Murinization |

The human genome encodes for two highly homologous TCR beta constant chains; TCR beta1 (TCRβ1 or TCRb1 or cβ1) and TCR beta 2 (TCRβ2 or TCRb2 or cβ2). The CARs of the disclosure can comprise either of these two chains. Similarly, either TCR beta1 or TCR beta2 chains of other mammalian species can be used in the methods of the disclosure.

The term "constant chain of T cell receptor-beta 1" or "constant region of T cell receptor-beta 1" (TCR-beta1 or TCRβ1 or TCRb1 or hTCR-beta1 or Cβ1) is defined as a protein provided as SEQ ID NO: 15051 or the equivalent residues (i.e., a homolog) from a non-human species, e.g., mouse, rodent, monkey, ape and the like.

The term "constant chain of T cell receptor-beta 2" or "constant region of T cell receptor-beta 2" (TCR-beta2 or TCRβ2 or TCRb2 or Cβ2) is defined as the protein provided as SEQ ID NO: 15052 or the equivalent residues (i.e., a homolog) from a non-human species, e.g., mouse, rodent, monkey, ape and the like.

The term "constant chain of T cell receptor-beta" or "constant region of T cell receptor-beta" (TCR-beta or TCRβ or TCRb or Cβ)" is defined as the protein provided as SEQ ID NO: 15051-15053 or the equivalent residues (i.e., a homolog) from a non-human species, e.g., mouse, rodent, monkey, ape and the like.

The protein sequences for both Cβ2 (SEQ ID NO: 15052) and Cβ1 (SEQ ID NO: 15051) are known (Table 6D). Differences between the sequences of Cβ2 and β1 are easily identified by alignment of the sequences using typical and ordinary skill in the art. The disclosure also provides certain mutations to TCRβ's that can be used in the construction of SIRs and Ab-TCRs. For example, sites of mutation in Cβs that demonstrate increased expression and decreased mispairing with the endogenous TCRα chains are provided herein. These mutation sites in Cβ1 and Cβ2 are located at positions 18, 22, 57, 79 133, 136, and 139 of SEQ ID NOs: 15051 and 15052 and are summarized in the Tables 4 and 5 below. The mutation sites in Cβ1 and Cβ2 are identical in their positions. The only difference between the two sequences is that a mutation at position 136. At this position, a glutamic acid (E) is present in Cβ2, whereas a valine is present in Cβ1.

TABLE 4

Mutations according to the disclosure in
the human constant TCR-beta region1 (Cβ1)

| Position (SEQ ID NO: 15051) | Amino acid in wild-type | Mutation | TYPE |
| --- | --- | --- | --- |
| 15 | E | C | disulfide bond |
| 17 | S | C | disulfide bond |
| 18 | E | K or R | Murinization |
| 22 | S | A | Murinization |
| 57 | S | C | disulfide bond |
| 59 | D | C | disulfide bond |
| 77 | S | C | disulfide bond |
| 79 | R | G | Knob into Hole |
| 133 | F | I | Murinization |
| 136 | V | A | Murinization |
| 139 | Q | H | Murinization |

TABLE 5

Mutations according to the disclosure in
the human constant TCR-beta region2 (Cβ2)

| Position (SEQ ID NO: 15052) | Amino acid in wild-type | Mutation | TYPE |
| --- | --- | --- | --- |
| 15 | E | C | disulfide bond |
| 17 | S | C | disulfide bond |
| 18 | E | K or R | Murinization |
| 22 | S | A | Murinization |
| 57 | S | C | disulfide bond |
| 59 | D | C | disulfide bond |
| 77 | S | C | disulfide bond |
| 79 | R | G | Knob into Hole |
| 133 | F | I | Murinization |
| 136 | E | A | Murinization |
| 139 | Q | H | Murinization |

The term "constant chain of TCR-gamma" or "constant region of TCR-gamma" (TCR-gamma or TCRγ or TCRg or TCR-gamma1 or TCRγ1 or TCRg1 or Cγ) is defined as the protein provided as SEQ ID NO: 15068 or the equivalent residues (i.e., a homolog) from a non-human species, e.g., mouse, rodent, monkey, ape and the like.

The term "constant chain of TCR-delta" or "constant region of TCR-delta" (TCR-delta or TCRδ or TCRd or Cδ)

is defined as the proteins provided as SEQ ID NO: 15069 or the equivalent residues (i.e., a homolog) from a non-human species, e.g., mouse, rodent, monkey, ape and the like.

It will be recognized that proteins can have identity or homology to one another and retain similar or identical functions. The disclosure includes TCR constant regions that have 85%, 90%, 95%, 97%, 98%, 98.5%, 99% or 99.9% identity to any of the sequences described herein while retaining the biological activity.

Accordingly, the disclosure provides a T-cell receptor constant chain having a sequence selected from the group consisting of: (a) an amino acid sequence that is at least 98% identical to SEQ ID NO:15041 and which can have one or more mutations at positions 61, 91, 92, 93, and/or 94; (b) an amino acid sequence that is at least 98% identical to SEQ ID NO:15051 and can have one or more mutations at positions 18, 22, 57, 79, 133, 136 and/or 139; (c) an amino acid sequence that is at least 98% identical to SEQ ID NO:15052 and can have one or more mutations at position 18, 22, 57, 79, 133, 136 and/or 139; (d) an amino acid sequence that is at least 98% identical to SEQ ID NO:15068; and (e) an amino acid sequence that is at least 98% identical to SEQ ID NO:15069. The T-cell receptor constant chains of any of (a)-(e) retain at least one biological activity of the wild-type T-cell receptor constant chain to which it has identity or homology.

The term "constitutively active" refers to a molecule, e.g., a protein, that has signaling activity without the need of a stimulus. Exemplary constitutive active proteins are NEMO-K277A and vFLIP K13 as they can activate NF-κB signaling when expressed in a suitable cell without the need of an additional stimulus.

The term a "costimulatory molecule" or a "costimulatory receptor" refers to a cognate binding partner on a T cell that specifically binds with a costimulatory ligand, thereby mediating a costimulatory response by the T cell, such as, but not limited to, proliferation. Costimulatory extracellular molecules are cell surface molecules other than antigen receptors or their ligands that contribute to an efficient immune response. Costimulatory molecules include, but are not limited to an MHC class I molecule, BTLA and a Toll ligand receptor, as well as OX40, Dap10, CD27, CD28, CD2, CDS, CD8, ICAM-1, LFA-1 (CD11a/CD18), ICOS (CD278), Lck, TNFR-I, TNFR-II, Fas, CD30, CD40 and 4-1BB (CD137). Further examples of such costimulatory molecules include CD8, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CDlld, ITGAE, CD103, ITGAL, CDlla, LFA-1, ITGAM, CD11b, ITGAX, CDllc, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRT AM, Ly9 (CD229), CD160 (BY55), PSGL1, CD100 (SEMA4D), CD69, SLAMF6 (NTB-A, Ly108), SLAM (SLAMF1, CD150, IP0-3), BLAME (SLAMF8), SELPLG (CD162), LTBR, LAT, GADS, SLP-76, PAG/Cbp, CD19a, and a ligand that specifically binds with CD83. A co-stimulatory receptor may be expressed on cells other T cells, such as NK cells or macrophages.

A "costimulatory intracellular signaling domain" or "costimulatory domain" (CSD) can be the intracellular portion of a costimulatory receptor. A costimulatory molecule can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, ICAM-1, lymphocyte function-associated antigen-1 (LFA-1), CD2, CD8, CD7, CD287, LIGHT, NKG2C, NKG2D, SLAMF7, NKp80, NKp30, NKp44, NKp46, CD160, B7-H3, and a ligand that specifically binds with CD83, and the like. The intracellular signaling domain can comprise the entire intracellular portion, or the entire native intracellular signaling domain, of the molecule from which it is derived, or a functional fragment or derivative thereof. The CARs of the disclosure may comprise one or more co-stimulatory domains.

The term "cTCR" refers to a wild-type TCR nucleic acid coding sequence and the corresponding wild-type TCR protein linked to an antigen binding domain. cTCRs are used in some embodiments and reference controls. For example, a cTCR having a CD19 binding domain and a CD19-CAR (comprising a mutant TCR chain and CD19 binding domain) will have different expression and/or difference binding affinities to the target antigen.

The term "cytosolic" or "cytoplasmic" refers to an agent, e.g., a protein, that is situated in the cytoplasm of a cell in its mature form. A cytosolic protein can translocate into the nucleus but is not a transmembrane protein and is not secreted outside the cell. An exemplary cytosolic protein is vFLIP K13.

The term "degenerative disorders" refers to a disease that is the result of a continuous process based on degenerative cell changes, affecting tissues or organs, which will increasingly deteriorate over time, whether due to normal bodily wear or lifestyle choices such as exercise or eating habits. Exemplary degenerative diseases include Alzheimer's disease, Charcot-Marie-Tooth disease, Creutzfeldt-Jakob disease, Friedreich's ataxia, Diabetes mellitus (type II), and Atherosclerosis.

"Derived from" as that term is used herein, indicates a relationship between a first and a second molecule. It generally refers to structural similarity between the first molecule and a second molecule and does not connotate or include a process or source limitation on a first molecule that is derived from a second molecule. For example, in the case of an antigen binding domain that is derived from an antibody molecule, the antigen binding domain retains sufficient antibody structure such that is has the required function, namely, the ability to bind to an antigen. It does not connotate or include a limitation to a particular process of producing the antibody, e.g., it does not mean that, to provide the antigen binding domain, one must start with an antibody sequence and delete unwanted sequence, or impose mutations, to arrive at the antigen binding domain.

"Dimerization molecule," as that term is used herein refers to a molecule that promotes the association of a first switch domain with a second switch domain. In embodiments, the dimerization molecule does not naturally occur in the subject, or does not occur in concentrations that would result in significant dimerization. In embodiments, the dimerization molecule is a small molecule, e.g., rapamycin or a rapalogue, e.g, RAD001, Rimiducid or AP20187. Rimiducid (AP1903) is a lipid-permeable tacrolimus analogue with homodimerizing activity. Rimiducid homodimerizes an analogue of human protein FKBP12 (Fv) which contains a single acid substitution (Phe36Val). Rimiducid is used to homodimerize the Fv-containing drug-binding domains of non-naturally occurring immune receptor resulting in downstream signaling activation during cell therapy. Rimiducid can be at about 0.01-1 mg/kg and has an EC50 in cell culture of about 0.1 nM. AP20187 can be administered from about 2-10 mg/kg/day in single or multi-doses.

The phrase "disease associated with expression of a target antigen" or "disease associated antigen as described herein" includes, but is not limited to, a disease associated with expression of a target antigen as described herein or condition associated with cells which express a target antigen as described herein including, e.g., proliferative diseases such as a cancer or malignancy or a precancerous condition such as a myelodysplasia, a myelodysplastic syndrome or a pre leukemia; or a noncancer related indication associated with cells which express a target antigen as described herein. In one aspect, a cancer associated with expression of a tumor antigen as described herein is a hematological cancer. In one aspect, a cancer associated with expression of a tumor antigen as described herein is a solid cancer. Further diseases associated with expression of a tumor antigen described herein include, but are not limited to, atypical and/or non-classical cancers, malignancies, precancerous conditions or proliferative diseases associated with expression of a tumor antigen as described herein. Non-cancer related indications associated with expression of a target antigen as described herein include, but are not limited to, e.g., autoimmune disease, (e.g., lupus), inflammatory disorders (allergy and asthma) and transplantation. In some embodiments, the target antigen-expressing cells express, or at any time expressed, mRNA encoding the target antigen. In another embodiment, the target antigen-expressing cells produce the target antigen protein (e.g., wild-type or mutant), and the target antigen protein may be present at normal levels or reduced levels. In another embodiment, the target antigen-expressing cells produced detectable levels of a target antigen protein at one point, and subsequently produced substantially no detectable target antigen protein.

"Disease targeted by genetically modified cells" as used herein encompasses the targeting of any cell involved in any manner in any disease by the genetically modified cells of the invention, irrespective of whether the genetically modified cells target diseased cells or healthy cells to effectuate a therapeutically beneficial result. The genetically modified cells include but are not limited to genetically modified T-cells, NK cells, hematopoietic stem cells, pluripotent embryonic stem cells or embryonic stem cells. The genetically modified cells express the conventional CARs and novel backbones containing conventional CARs with accessory modules of the invention, which CARs may target any of the antigens expressed on the surface of target cells. Examples of antigens which may be targeted include but are not limited to antigens expressed on B-cells; antigens expressed on carcinomas, sarcomas, lymphomas, leukemia, germ cell tumors, and blastomas; antigens expressed on various immune cells; and antigens expressed on cells associated with various hematologic diseases, autoimmune diseases, and/or inflammatory diseases. Other antigens that may be targeted will be apparent to those of skill in the art and may be targeted by the CARs of the invention in connection with alternate embodiments thereof.

The term "Dissociation constant (Kd)" is defined as the equilibrium constant of the dissociation of a receptor-ligand interaction.

As used herein a "diverse set of non-naturally occurring immune receptors" or "diverse set of SIRs" or "diverse set of CARs" refers to a plurality of non-naturally occurring immune receptors having the same binding domain linked to a diverse set of T cell receptor constant chains or "backbones" wherein each construct comprising a binding domain and a different T cell constant chain or backbone provide a diverse range of binding to a target antigen and/or varied expression levels. For example, depending upon the mutation composition of the constant domain (e.g., mutant TCRa+TCRb), the binding affinity of the binding domain to its target varies. In some embodiments, a SIR of the disclosure (single strand or heterodimer) comprises a binding affinity that is greater than a wild-type TCR (e.g., cTCR) with the same binding domain. In one embodiment a SIR has a higher expression level than a cTCR by at least 1.25 fold to about 10,000 fold higher (and any number in between), wherein the SIR and cTCR differ only in the mutation in the TCR domain. In another embodiment, a SIR has a binding affinity for a target that is at least 1.5 fold higher to about 10,000 fold higher than a cTCR having a binding domain to the same antigen. In yet another embodiment, the SIR has a higher binding affinity than a cTCR to the same antigen, but less than a chimeric antigen receptor (CAR) having the same binding domain. In some embodiments, the binding of a SIR expressing effector cell to the target antigen is at least 1.25-fold more than the binding of a corresponding cTCR-expressing effector cell but less than 100,000 fold more than the corresponding cTCR. In some embodiment, the antigen binding domain has a disassociation constant ($K_D$, reflecting its binding affinity) from between about $10^{-4}$ M to $10^{-8}$M. In some embodiments, the antigen binding domain binds to one or more of the antigens recited above. In some embodiment, the antigen binding domain has a $K_D$ of between about $10^{-4}$M to $10^{-8}$M, e.g., between about $10^{-5}$M to $10^{-7}$M, e.g., between about $10^{-5}$M to $10^{-6}$ M, for the target antigen. In one embodiment, the binding affinity of the antigen binding domain is at least five-fold, 10-fold, 20-fold, 30-fold, 50-fold, 100-fold or 1,000-fold less than a reference antibody. In one embodiment, the encoded antigen binding domain has a binding affinity at least 5-fold less than a reference antibody. In some embodiments, the reference antibody is an antibody from which the antigen binding domain is derived. For example, the disclosure contemplates a diverse population of SIRs against a particular antigen target that can be designed and screened based upon the nucleic acid sequence codon optimization and/or the mutation in the TCR chain to promote pairing or expression and/or the use of a linker between the binding domain and the TCR domain.

As used herein, an "epitope" is defined to be the portion of an antigen capable of eliciting an immune response, or the portion of an antigen that binds to an antibody or antibody fragment. Epitopes can be a protein sequence or subsequence.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adena-associated viruses) that incorporate the recombinant polynucleotide.

The term "functional portion" when used in reference to a CAR refers to any part or fragment of the CAR, which part or fragment retains the biological activity of the CAR of which it is a part (the parent CAR). Functional portions encompass, for example, those parts of a CAR that retain the ability to recognize target cells, or detect, treat, or prevent a disease, to a similar extent, the same extent, or to a higher extent, as the parent CAR. In reference to the parent CAR, the functional portion can comprise, for instance, about 10%, 25%, 30%, 50%, 68%, 80%, 90%, 95%, or more, of the parent CAR.

"Genetically modified cells", "redirected cells", "genetically engineered cells" or "modified cells" as used herein refer to cells that express a CAR of the disclosure. In some embodiments, the genetically modified cells comprise vectors that encode a CAR. In some embodiments, the genetically modified cells comprise vectors that encode a CAR and one or more accessory molecules in the same vector. In some embodiments, the genetically modified cells comprise a first vector that encodes a CAR and a second vector that encodes the accessory molecule. In some embodiments, the genetically modified cells comprise a first vector that encodes a CAR and a second vector that encodes more than one accessory molecule. In some embodiments, the genetically modified cells comprise a first vector that encodes a CAR and a second vector that encodes the first accessory molecule and a third vector that encodes a second accessory molecule.

"Hinge region" (HR) as used herein refers to the hydrophilic region which is between the antigen binding domain and the transmembrane domain. The hinge regions include but are not limited to Fc fragments of antibodies or fragments or derivatives thereof, hinge regions of antibodies or fragments or derivatives thereof, CH2 regions of antibodies, CH3 regions of antibodies, artificial spacer sequences or combinations thereof. Examples of hinge regions include but are not limited to CD8a hinge, and artificial spacers made of polypeptides which may be as small as, for example, Gly3 or CH1 and CH3 domains of IgGs (such as human IgG4). In some embodiments, the hinge region is any one or more of (i) a hinge, CH2 and CH3 regions of IgG4, (ii) a hinge region of IgG4, (iii) a hinge and CH2 of IgG4, (iv) a hinge region of CD8a, (v) a hinge, CH2 and CH3 regions of IgG1, (vi) a hinge region of IgG1 or (vi) a hinge and CH2 region of IgG1. Other hinge regions will be apparent to those of skill in the art and may be used in connection with alternate embodiments of the disclosure.

The term "immune disorder" refers to a disease characterized by dysfunction of immune system. An autoimmune disease is a condition arising from an abnormal immune response to a normal body part. There are at least 80 types of autoimmune diseases.

"Immune cell" as used herein refers to the cells of the mammalian immune system including but not limited to antigen presenting cells, B-cells, basophils, cytotoxic T-cells, dendritic cells, eosinophils, granulocytes, helper T-cells, leukocytes, lymphocytes, macrophages, mast cells, memory cells, monocytes, natural killer cells, neutrophils, phagocytes, plasma cells and T-cells.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NKT) cells, mast cells, and myeloic-derived phagocytes.

"Immune effector function" or "immune effector response," "effector function" refers to the specialized function of a differentiated cell. Effector function of a T-cell, for example, may be cytolytic activity or helper activity including the secretion of cytokines. For example, an immune effector function or response refers a property of a T or NK cell that promotes killing or the inhibition of growth or proliferation, of a target cell. In the case of a T cell, primary stimulation and co-stimulation are examples of immune effector function or response. In case of antigen presenting cells (e.g., dendritic cells) antigen presentation and cytokine secretion are examples of effector functions.

"Immune response" as used herein refers to immunities including but not limited to innate immunity, humoral immunity, cellular immunity, immunity, inflammatory response, acquired (adaptive) immunity, autoimmunity and/ or overactive immunity.

An "intracellular signaling domain," (ISD) or "cytoplasmic domain" as the term is used herein, refers to an intracellular signaling portion of a molecule. The intracellular signaling domain generates a signal that promotes an immune effector function of the cell. Examples of immune effector function include cytolytic activity and helper activity, including the secretion of cytokines. Examples of domains that transduce the effector function signal include but are not limited to the z chain of the T-cell receptor complex or any of its homologs (e.g., h chain, FceR1g and b chains, MB1 (Iga) chain, B29 (Igb) chain, etc.), human CD3 zeta chain, CD3 polypeptides (D, d and e), syk family tyrosine kinases (Syk, ZAP 70, etc.), src family tyrosine kinases (Lck, Fyn, Lyn, etc.) and other molecules involved in T-cell transduction, such as CD2, CD5 and CD28. Other intracellular signaling domains will be apparent to those of skill in the art and may be used in connection with alternate embodiments of the disclosure.

In another embodiment, the intracellular signaling domain can comprise a primary intracellular signaling domain. Exemplary primary intracellular signaling domains include those derived from the molecules responsible for primary stimulation, or antigen dependent simulation. In another embodiment, the intracellular signaling domain can comprise a costimulatory intracellular domain. Exemplary costimulatory intracellular signaling domains include those derived from molecules responsible for costimulatory signals, or antigen independent stimulation. For example, a primary intracellular signaling domain can comprise a cytoplasmic sequence of CD3z, and a costimulatory intracellular signaling domain can comprise cytoplasmic sequence from co-receptor or costimulatory molecule, such as CD28 or 41BB.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, common FeR gamma (FCER1G), Fe gamma RIIa, FeR beta (Fe Epsilon Rib), CD3 gamma, CD3 delta, CD3 epsilon, CD79a, CD79b, DAP1O, and DAP12.

The term "isolated" as used herein refers to molecules or biologicals or cellular materials being substantially free from other materials. In one aspect, the term "isolated" refers to nucleic acid, such as DNA or RNA, or protein or polypeptide (e.g., an antibody or derivative thereof), or cell or cellular organelle, or tissue or organ, separated from other DNAs or RNAs, or proteins or polypeptides, or cells or cellular organelles, or tissues or organs, respectively, that are present in the natural source. The term "isolated" also refers to a nucleic acid or peptide that is substantially free of cellular material, viral material, or culture medium when produced by recombinant DNA techniques, or chemical precursors or other chemicals when chemically synthesized. Moreover, an "isolated nucleic acid" is meant to include nucleic acid fragments which are not naturally occurring as fragments and would not be found in the natural state. The term "isolated" is also used herein to refer to polypeptides which are isolated from other cellular proteins and is meant to encompass both purified and recombinant polypeptides. The term "isolated" is also used herein to refer to cells or tissues that are isolated from other cells or tissues and is meant to encompass both, cultured and engineered cells or tissues.

As used herein, the term "linker" (also "linker domain" or "linker region") refers to an oligo or a polypeptide (or an oligo encoding the polypeptide) that joins together two or more domains or regions of a CAR polynucleotide or polypeptide, respectively, disclosed herein. The linker can be anywhere from 1 to 500 amino acids in length or 3 to 1500 nucleotide in length. In some embodiments the "linker" is cleavable or non-cleavable. Unless specified otherwise, the term "linker" used herein means a non-cleavable linker. Said non-cleavable linkers may be composed of flexible residues which allow freedom of motion of adjacent protein domains relative to one another. Non-limiting examples of such residues include glycine and serine. In some embodiments, linkers include non-flexible residues. Examples of cleavable linkers include 2A linkers (for example T2A), 2A-like linkers or functional equivalents thereof and combinations thereof. In some embodiments, the linkers include the picornaviral 2A-like linker, CHYSEL sequences of porcine teschovirus (P2A), Thosea asigna virus (T2A) or combinations, variants and functional equivalents thereof. In some embodiments, the linker sequences may comprise a motif that results in cleavage between the 2A glycine and the 2B proline (see, e.g., T2A sequence, SEQ ID NO: 4839 and 4840, C-terminal Gly-Pro). The nucleic sequences of several exemplary cleavable linkers are provided in SEQ ID NO: 925 to SEQ ID NO: 930 and amino acid sequences of several exemplary linkers are provided in SEQ ID NO: 4838 to SEQ ID NO: 4843. Other cleavable linkers that may be used herein are readily appreciated by those of skill in the art.

In an embodiment, a Ser-Gly-Ser-Gly (SGSG) motif (SEQ ID NOs: 931-32) is also added upstream of the cleavable linker sequences to enhance the efficiency of cleavage. A potential drawback of the cleavable linkers is the possibility that the small 2A tag left at the end of the N-terminal protein may affect protein function or contribute to the antigenicity of the proteins. To overcome this limitation, in some embodiments, a furine cleavage site (RAKR) (SEQ ID NO: 933-935) is added upstream of the SGSG motifs to facilitate cleavage of the residual 2A peptide following translation.

The term "flexible polypeptide linker" as used herein refers to a peptide linker that consists of amino acids such as glycine and/or serine residues used alone or in combination, to link polypeptide chains together (e.g., variable heavy and variable light chain regions together). In one embodiment, the flexible polypeptide linker is a Gly/Ser linker and comprises the amino acid sequence (Gly-Gly-Gly-Ser)$_n$, (SEQ ID NO:4191-4192) where n is a positive integer equal to or greater than 1. For example, n=1, n=2, n=3. n=4, n=5 and n=6, n=7, n=8, n=9 and n=10. In one embodiment, the flexible polypeptide linkers include, but are not limited to, (Gly$_4$Ser)$_4$ or (Gly$_4$Ser)$_3$ (SEQ ID NO:4193 or 4194). Also included within the scope of the disclosure are linkers described in WO2012/138475, incorporated herein by reference).

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lenti viruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art. Other examples of lentivirus vectors are pLENTI-EF1α (SEQ ID NO: 3837), pLENTI-EF1α-DWPRE (SEQ ID NO: 3838), pCCLc-MNDU3-WPRE (SEQ ID NO: 7779) and pCCLc-MNDU3-Eco-Nhe-Sal-WPRE (SEQ ID NO: 7780). pLenti-EF1a-DWPRE was derived from the pLENTI-EF1α vector by deletion of WPRE sequence. An internal Sac II fragment was deleted from the EF 1α promoter to generate EF 1 alpha (EF1a)-D-SACII-Promoter (SEQ ID NO: 3842). In an exemplary embodiment, the nucleic acid fragment encoding a CAR, CAR plus accessory module(s), or the accessory module(s) can be cloned between the Nhe I and Sal I sites present in the pLENTI-EF1a and the pCCLc-MNDU3-Eco-Nhe-Sal-WPRE vectors using methods known in the art.

"Mammal" as used herein refers to any member of the class Mammalia, including, without limitation, humans and nonhuman primates such as chimpanzees and other apes and monkey species; farm animals such as cattle, sheep, pigs, goats and horses; domestic mammals such as dogs and cats; laboratory animals including rodents such as mice, rats and guinea pigs, and the like. The term does not denote a particular age or sex. Thus, adult and newborn subjects, as well as fetuses, whether male or female, are intended to be included within the scope of this term.

"Naked DNA" as used herein refers to DNA encoding a CAR cloned in a suitable expression vector in proper orientation for expression. Viral vectors which may be used include but are not limited SIN lentiviral vectors, retroviral vectors, foamy virus vectors, adeno-associated virus (AAV) vectors, hybrid vectors and/or plasmid transposons (for example sleeping beauty transposon system) or integrase based vector systems. Other vectors that may be used in connection with alternate embodiments of the invention will be apparent to those of skill in the art.

"Native" or "Naturally occurring" or "endogenous" as used herein refers to a gene, protein, nucleic acid (e.g., DNA, RNA etc.) or fragment thereof that is native to a cell or is naturally expressed in a cell. Thus, a native or endogenous TCRα chain polypeptide of a T cell consists of a variable domain (Va) joined to a TCRα constant chain. The native or endogenous TCRα chain precursor polypeptide also consists of an amino-terminal signal peptide that is cleaved from the mature polypeptide.

NF-Kappa-B Essential Modulator (NEMO) refers to a scaffolding protein component of IκB kinase complex required for NF-κB activation. NF-κB is a transcription factor that controls inflammation, cell proliferation and apoptosis.

"NF-κB pathway" or "NF-κB signaling pathway" refers to a signal transducton pathway that results in the nuclear translocation of NF-κB subunits and transcriptional activation of NF-κB subunit responsive genes. NF-κB refers to family of transcription factors that are involved in the regulated expression of several genes involved in the inflammatory and immune response. Five known members of this family have been characterized to date and include c-Rel, NF-κB1 (p50 and its precursor p105), NF-κB2 (p52 and its precursor p105), p65(RelA) and RelB. Although many dimeric forms of NF-κB have been described, the classical NF-κB complex is a heterodimer of the p65/RelA and p50 subunits and is found in most cells in association with a family of inhibitory proteins, called IκBs, of which the most common is IκBα. In the classical NF-κB pathway, stimulation by a number of cytokines, such as TNFα and IL-1, results in the activation of a multi-subunit IκB kinase (IKK) complex, which contains two catalytic subunits, IKK1/ IKKα and IKK2/IKKβ, and a regulatory subunit, NEMO/ IKKγ. The activated IKK complex leads to the inducible phosphorylation of IκB proteins and their subsequent degradation, thereby releasing NF-κB from their inhibitory influence. Once released, NF-κB is free to migrate to the nucleus and bind to the promoter of specific genes possessing its cognate binding site. The transcriptional activity of the NF-κB dimers in the nucleus is further modified by their phosphorylation. An an alternative (or noncanonical) pathway of NF-κB activation, that involves proteasome-mediated processing of p100/NF-κB2 into p52 subunit, has been described.

"NF-κB stimulatory molecule" or "NF-κB stimulator" or "NF-κB activator" refers to a subset of accessory molecules that promote the activity of the NF-κB signaling pathway or the activity/expression of the downstream target genes of the NF-κB signaling pathway. In some embodiments, a NF-κB activator is a non-naturally occurring NF-κB activating agent. An exemplary non-naturally occurring NF-κB activating agent is hNEMO-K277A. In one embodiment, the NF-κB stimulatory molecule or NF-κB stimulator is a selective NF-κB stimulator or a selective NF-κB activator. A "selective NF-κB activator" or a "selective NF-κB stimulator" as described herein, refers to an agent that activates the NF-κB signaling pathway selectively with no or minimal activation of the other signaling pathways. In one embodiment, a selective NF-κB activator activates NF-κB signaling pathway with no or minimal activation of one or more of signaling pathways selected from the group of AKT, PI3K, JNK, p38 kinase, ERK, JAK/STAT and interferon signaling pathways. In one embodiment, a selective NF-κB activator activates NF-κB signaling pathway with no or minimal activation of AKT signaling pathway. In one embodiment, a selective NF-κB activator activates NF-κB signaling pathway with no or minimal activation of AKT signaling pathway. In one embodiment, a selective NF-κB activator activates NF-κB signaling pathway with no or minimal activation of PI3K signaling pathway. In one embodiment, a selective NF-κB activator activates NF-κB signaling pathway with no or minimal activation of ERK signaling pathway. In one embodiment, a selective NF-κB activator activates NF-κB signaling pathway with no or minimal activation of JNK signaling pathway. In one embodiment, a selective NF-κB activator activates NF-κB signaling pathway with no or minimal activation of p38 kinase signaling pathway. In one embodiment, a selective NF-κB activator activates NF-κB signaling pathway with no or minimal activation of JAK/STAT signaling pathway. In one embodiment, a selective NF-κB activator activates NF-κB signaling pathway with no or minimal activation of interferon signaling pathway. A number of methods to measure the activation of the NF-κB signaling pathways are known in the art, including but not limited to measurement of phosphorylated IκBa, phosphorylated p65/RelA, total IκBa, p65 nuclear translocation, upregulation of NF-κB responsive genes, electrophoretic mobility-shift assay (EMSA) and NF-κB- based reporter assay etc. These assays can be used in the methods of the disclosure either singly or in combinations to identify selective activators of NF-κB pathway. A number of methods to measure the activation of the signaling pathways (e.g., AKT, PI3K, JNK, p38 kinase, ERK, JAK/STAT and interferon signaling pathways) are known in the art, including but not limited to measurement of phosphorylation of the different kinases and downstream substrates belonging to the different pathways, nuclear translocation of downstream transcription factors, upregulation of the downstream responsive genes, electrophoretic mobility shift assay (EMSA) and luciferase based reporter assay etc. These assays can be used in the methods of the disclosure either singly or in combinations to select selective activators of NF-κB signaling pathway. A selective NF-κB stimulator specifically activates NF-κB compared to other accessory molecules such as 41BB. A NF-κB stimulatory molecule, including a selective NF-κB activator, has one or more of the following effects: (i) extend the life span of T cells, e.g., CAR-T cells or TCR-T cells, (ii) stimulate T cell proliferation, (iii) protect T cells, e.g., CAR-T cells, from apoptosis, (iv) delay senescence of T cells, e.g., CAR-T cells or TCR-T cells (v) delay exhaustion of T cells, e.g., CAR-T cells or TCR-T cells, (vi) delay terminal differentiation of T cells, (vii) promote production of cytokines, such as IL2, by T cells, (viii) promote in vivo expansion of T cells, including CAR-T cells and TCR-T cells, (ix) promote in vivo persistence of T cells, including CAR-T cells and TCR-T cells, (x) improve the in vivo activity (e.g., anti-tumor activity) of the T cells, including CAR-T and TCR-T cells. A NF-κB stimulatory molecule, including a selective NF-κB activator, may be expressed in cells other than T cells, such as antigen presenting cells, e.g., dendritc cells. A NF-κB stimulatory molecule, including a selective NF-κB activator, may be used to enhance the antigen presention, cytokine production and immune response generated by antigen presenting cells. An NF-κB stimulatory molecule, including a selective NF-κB activator, may be of viral or non-viral (e.g., human) origin. An NF-κB stimulatory molecule, including a selective NF-κB activator, may be expressed in a cell transiently or stably. An NF-κB stimulatory molecule, including a selective NF-κB activator, may be expressed in a cell in a constitutive or inducible manner. An NF-κB stimulatory molecule, including a selective NF-κB activator, may be expressed in a cell in fusion with a switch domain, e.g., tandem copies of a FKBP12v36 domain. Exemplary switch domain containing NF-κB stimulatory molecules are provided in SEQ ID NO: 973-977, 1006-1009, 7763-7767 and 7781-7782 (Table 7). An NF-κB stimulatory molecule, including a selective NF-κB activator, can be expressed from a vector containing a coding sequence for a CAR/TCR or may be present on a different vector. For example, in some embodiments, vectors comprising polynucleotides encoding CARs/TCRs further comprise polynucleotides encoding viral and cellular signaling proteins which are NF-κB stimulatory molecule or selective NF-κB activator that (i) extend the life span of T cells, e.g., CAR-T cells or TCR-T cells, (ii) stimulate T cell proliferation, (iii) protect T cells, e.g., CAR-T cells, from apoptosis, (iv) delay senescence of T cells, e.g., CAR-T cells or TCR-T cells (v) delay exhaustion of T cells, e.g., CAR-T cells or TCR-T cells, (vi) delay terminal differentiation of T cells, (vii) promote production of cytokines, such as IL2, by T cells, (viii) promote in vivo expansion of T cells, including CAR-T cells and TCR-T cells, (ix) promote in vivo persistence of T cells, including CAR-T cells and TCR-T cells, and/or (x) improve the in vivo activity (e.g., anti-tumor activity) of the T cells, including CAR-T and TCR-T cells. In some embodiments, the coding sequence for a NF-κB stimulatory molecule is linked to a CAR backbone coding sequence by an oligonucleotide encoding a cleavable linker. In exemplary embodiments, such NF-κB stimulatory molecules include but are not limited to vFLIP-K13 from Kaposi's sarcoma associated herpes virus, a codon optimized K13 (K13-opt), NEMO mutant ((e.g, hNEMO-K277A, hNEMO-K277L, hNEMO-K277A-deltaV249-K255, mNEMO-K270A etc), IKK2-S177E-S181E, IKK1-S176E-S180E, MyD88-L265P, TCL-1A, MTCP-1, IKKα, and IKKβ (Table 7). In one embodiment, vectors encoding CARs further encode vFLIP-K13. In another embodiment, vectors encoding CARs further encode hNEMO-K277A. In some embodiments, the NF-κB stimulatory molecule is encoded by a vector that is distinct from the vector encoding the CAR described herein. In some embodiments, effector cells comprising vectors encoding CARs also comprise vectors encoding NF-κB stimulatory molecule. In some embodiments, the NF-κB stimulatory molecules are encoded by modifying the genomic locus encoding the corresponding endogenous protein. For example, one or more copies of hNEMO gene can be modified by homologous recombination to mutate it to K277A mutant form. An exemplary targeting constructs that can be used to create K277A mutation in the endogenous human NEMO gene is presented by SEQ ID NO: 7771. An exemplary targeting constructs that can be used to create K277A-Delta-V249-K255 mutation in the endogenous human NEMO gene is presented by SEQ ID NO: 7772. These targeting constructs can be introduced into human T cells with a gene editing system targeting NEMO, e.g., CRISP/Cas9 or TALON, using techniques known in the art. Exemplary NEMO gRNA target sequences for Streptococcus Pyogenes Cas9 are provided in SEQ ID NO: 7759-7762. In one embodiment, the CAR and the NF-κB stimulatory molecule are encoded by a single polynucleotide. In another embodiment, the CAR is encoded by the first nucleic acid molecule and the NF-κB stimulatory molecule is encoded by a second nucleic acid molecule. In some embodiments, the NF-κB stimulatory molecule is encoded by more than one nucleic acid molecule, depending on the number of NF-κB stimulatory molecules. In certain portions of the disclosure the abbreviation "CAR/NFκB" is used to indicate, for example, a cell that expresses both a CAR of the disclosure and an NF-κB stimulatory molecule (e.g., a NF-κB specific stimulatory molecule). For example, the term "CAR/NFκB-expressing T cell" refers to a CAR-T cells having any number of possible different antigen binding domains that also expresses, for example, an NF-κB specific stimulatory molecule selected from the group consisting of vFLIP-K13 from Kaposi's sarcoma associated herpes virus, a codon optimized K13 (K13-opt), hNEMO-K277A, hNEMO-K277A-deltaV249-K555, mNEMO-K270A, IKK2-S177E-S181E, IKK1-S176E-S180E, MyD88-L265P, TCL-1A, MTCP-1, IKK1/IKKa, and IKK2/IKKβ, or any combination thereof. The NF-κB stimulatory molecule may be directly linked to the cytoplasmic domain of the CAR or may be independently expressed in the cell. The NF-κB stimulatory molecule may be a molecule that blocks the expression and or activity of an inhibitor of NF-κB signaling pathway. For example, a NF-κB stimulatory molecule that blocks the expression and or activity of an inhibitor of NF-κB signaling pathway is a genetic (e.g., siRNA, shRNA, gRNA, TALON, or Zn finger nuclease), chemical or biological inhibitor of A20. Other embodiments include NEMO-fusion constructs as NF-κB stimulatory molecules (e.g., hNEMO-FKBPx2, FKBPx2-hNEMO-L600 etc.).

As used herein a "non-naturally occurring agent" or "non-native" or "exogenous" refers to an agent that is not naturally expressed in a cell. Stated another way, the non-naturally occurring agent is "engineered" to be expressed in a cell. A non-naturally occurring agent may be a cloned version of a naturally occurring agent. Exemplary non-naturally occurring agents include CARs, SIRs, Ab-TCRs, TFPs, recombinant TCR, NEMO-K277A, vFLIP-K13 and K13-opt. A non-naturally occurring agent may be expressed into a cell using techniques of gene transfer known in the art, such as lentiviral or retroviral mediated gene transfer. A non-naturally occurring agent may be expressed in an immune cell using an exogenous promoter (e.g., EF1a promoter) or an endogenous promoter (e.g., TCRa promoter). When an endogenous gene (e.g., IKK1, IKK2, IKKγ/NEMO) is cloned and ectopically expressed in a cell, it represents another example of a non-naturally occurring agent.

As used herein a "non-naturally occurring immune receptor" or "exogenous immune receptor" refers to an immune receptor that is not naturally expressed in an immune cell. Stated another way, the non-naturally occurring immune receptor is "engineered" to be expressed in an immune cell. A non-naturally occurring immune receptor may be a cloned version of a naturally occurring immune receptor. Alternatively, a non-naturally occurring immune receptor may be a chimeric receptor that is produced using recombinant molecular biology techniques. Exemplary non-naturally occurring immune receptors include CARs, SIR, Ab-TCRs, TFPs and recombinant TCR. A non-naturally occurring immune receptor may be introduced into an immune cell using techniques of gene transfer known in the art, such as lentiviral or retroviral mediated gene transfer. A non-naturally occurring immune receptor may be expressed in an immune cell using an exogenous promoter (e.g., EF1α promoter) or an endogenous promoter (e.g., TCRα promoter).

As used herein a "non-naturally occurring TCR antigen binding domain" or "exogenous TCR antigen binding domain" refers to a binding domain operably linked to a TCR constant region that is chimeric and non-naturally occurring with respect to a TCR present in nature. Stated another way, the non-naturally occurring TCR antigen binding domain is "engineered" using recombinant molecular biology techniques to be operably linked to a TCR and moreover, that the antigen binding domain is obtain or derived from a molecule that is distinct from a TCR found in nature. An antigen binding domain that is distinct from a TCR in nature includes antibody vH and vL fragments, humanized antibody fragments, chimeric antibody fragments, receptor ligands, and the like.

As used herein a "non-viral origin" refers to an agent (e.g., a protein) that is not wholly or in part encoded by a virus or has any domain or region of more than 10 amino acids (e.g, more than 15 amino acids, 20 amino acids, 25 amino acids or 50 amino acids) with greater than 80% (e.g., more than 85%, 90%, 95%, or 99%) sequence homology to a virally encoded protein. In an embodiment, an agent of non-viral origin is of human origin. In an embodiment, an agent of non-viral origin is a selective NF-κB activator. An exemplary agent of non-viral origin that is a selective NF-κB activator is human NEMO-K277A (SEQ ID NO: 4892).

The term "operably linked" or "functionally linked" refers to functional linkage or association between a first component and a second component such that each component can be functional. For example, operably linked includes the association between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. In the context of two polypeptides that are operably linked a first polypeptide functions in the manner it would independent of any linkage and the second polypeptide functions as it would absent a linkage between the two.

"Percent identity" in the context of two or more nucleic acids or polypeptide sequences, refers to two or more sequences that are the same. Two sequences are "substantially identical" if two sequences have a specified percentage of amino acid residues or nucleotides that are the same (e.g., 60% identity, optionally 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more preferably over a region that is 100 to 500 or 1000 or more nucleotides (or 20, 50, 200 or more amino acids) in length.

For sequence comparison, generally one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Bioi. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, WI), or by manual alignment and visual inspection (see, e.g., Brent et al., (2003) Current Protocols in Molecular Biology).

Two examples of algorithms that can be used for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Bioi. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Bioi. 48:444-

453) algorithm which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6.

The term "polynucleotide", "nucleic acid", or "recombinant nucleic acid" refers to polymers of nucleotides such as deoxyribonucleic acid (DNA), and, where appropriate, ribonucleic acid (RNA).

A "protein" or "polypeptide", which terms are used interchangeably herein, comprises one or more chains of chemical building blocks called amino acids that are linked together by chemical bonds called peptide bonds.

The term "retrovirus vector" refers to a vector derived from at least a portion of a retrovirus genome. Examples of retrovirus vector include MSCVneo, MSCV-pac (or MSCV-puro), MSCV-hygro as available from Addgene or Clontech.

The term "Sleeping Beauty Transposon" or "Sleeping Beauty Transposon Vector" refers to a vector derived from at least a portion of a Sleeping Beauty Transposon genome.

The term "single chain variable region" or "scFv" refers to a fusion protein comprising at least one antibody fragment comprising a variable region of a light chain and at least one antibody fragment comprising a variable region of a heavy chain, wherein the light and heavy chain variable regions are contiguously linked, e.g., via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the vL and vH variable regions in either order, e.g., with respect to the N-terminal and C-terminal ends of the polypeptide, the scFv may comprise vL-linker-vH or may comprise vH-linker-vL. In this invention, a scFv is also described as vL-Gly-Ser-Linker-vH. Alternatively, a scFv is also described as (vL+vH) or (vH+vL).

The term "signaling domain" refers to the functional region of a protein which transmits information within the cell to regulate cellular activity via defined signaling pathways by generating second messengers or functioning as effectors by responding to such messengers.

The term "Synthetic Immune Receptor" or alternatively a "SIR" refers to a set of polypeptides, typically two in some embodiments, which when expressed in an effector cell, provides the cell with specificity for a target cell, typically a cancer cell, and with intracellular signal generation. SIRs represent next generation CAR platforms that are described in WO 2018/102795 A1 which is incorporated herein by reference. In a typical embodiment, a SIR comprises one or more antigen binding domains (e.g., antibody or antibody fragment, a ligand or a receptor) that bind to antigens as described herein, and are joined to one or more T cell receptor constant chains or regions via an optional linker. In some embodiments, the set of polypeptides are contiguous with each other. In some embodiments, a SIR comprises two or more sets of two or more polypeptides. The polypeptides of each set of SIR are contiguous with each other (functional polypeptide unit 1) but are not contiguous with the polypeptides of the other set (functional polypeptide unit 2). In some aspects, the T cell receptor constant chains (or regions) of the SIR is chosen from the constant chain of human T cell receptor-alpha (TCR-alpha or TCRα or TCRa or hTCR-alpha or hTCRα or hTCRa or Cα), human T cell receptor-beta1 (TCR-beta1 or TCRβ1 or TCRb1 or hTCR-beta1 or hTCRβ1 or hTCRb1 or Cβ1), human T cell receptor-beta 2 (TCR-beta2 or TCRβ2 or TCRb2 or hTCR-beta2 or hTCRβ2 or hTCRb2 or Cβ2 also designated TCR-beta, TCRβ or TCRb or Cβ), human Pre-T cell receptor alpha ((preTCR-alpha or preTCRα or preTCRa or preCα), human T cell receptor-gamma (TCR-gamma or TCRγ or TCRg or or hTCR-gamma or hTCRγ or hTCRg or hTCRγ1 or hTCR-gamma1, or Cγ), or human T cell receptor-delta (TCR-delta or TCRd or TCRδ or hTCR-delta or hTCRd or hTCRδ or Cδ). In some embodiments, the TCR constant chains of SIR are encoded by their wild-type nucleotide sequences while in other aspects the TCR constant chains of SIR are encoded by the nucleotide sequences that are not wild-type. In some embodiments, the TCR constant chains of SIR are encoded by their codon optimized sequences. In some embodiments, the TCR constant chains of SIR encode for the wild-type polypeptide sequences while in other embodiments the TCR constant chains of SIR encoded for polypeptides that carry one or more mutations. In some embodiments, the TCR constant chains of SIR are encoded by their codon optimized sequences that carry one or more mutations. A SIR that comprises an antigen binding domain (e.g., a scFv, or vHH) that targets a specific tumor maker "X", such as those described herein, is also referred to as X-SIR or XSIR. For example, a SIR that comprises an antigen binding domain that targets CD19 is referred to as CD19-SIR or CD19SIR. The TCR constant chain/domain of a SIR can be derived from the same species in which the SIR will ultimately be used. For example, for use in humans, it may be beneficial for the TCR constant chain of the SIR to be derived from or comprised of human TCR constant chains. However, in some instances, it is beneficial for the TCR constant chain to be derived from the same species in which the SIR will ultimately be used in, but modified to carry amino acid substitutions that enhance the expression of the TCR constant chains. For example, for use in humans, it may be beneficial for the TCR constant chain of the SIR to be derived from or comprised of human TCR constant chains but in which certain amino acids are replaced by the corresponding amino acids from the murine TCR constant chains. Such murinized TCR constant chains provide increased expression of the SIR. The SIR or functional portion thereof, can include additional amino acids at the amino or carboxy terminus, or at both termini, which additional amino acids are not found in the amino acid sequence of the TCR or antigen binding domain which make up the SIR. Desirably, the additional amino acids do not interfere with the biological function of the SIR or functional portion, e.g., recognize target cells, detect cancer, treat or prevent cancer, etc. More desirably, the additional amino acids enhance the biological activity, as compared to the biological activity of the parent SIR. The nucleic acid and amino acid sequences of exemplary SIRs are provided in SEQ ID NO: 3878-3879 and in Tables 10-11.

The term "stimulation," refers to a primary response induced by binding of a stimulatory molecule (e.g., a TCR/CD3 complex) with its cognate ligand (or target antigen) thereby mediating a signal transduction event, such as, but not limited to, signal transduction via the TCR/CD3. Stimulation can mediate altered expression of certain molecules.

The term "stimulatory molecule," refers to a molecule expressed by an immune cell (e.g., T cell, NK cell, B cell) that provides the cytoplasmic signaling sequence(s) that regulate activation of the immune cell in a stimulatory way for at least some aspect of the immune cell signaling pathway. In one aspect, the signal is a primary signal that is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing cytoplasmic signaling sequence includes, but is not limited to, those derived from CD3 zeta, common FeR gamma (FCERIG), Fe gamma RIIa, FeR beta (Fe Epsilon Rib), CD3 gamma, CD3 delta, CD3 epsilon, CD79a, CD79b, DAPIO, and DAP12.

The term "subject" is intended to include living organisms in which an immune response can be elicited (e.g., any domesticated mammals or a human).

"Switch domain," or a "dimerization domain" as used herein, typically refers to a polypeptide-based entity that, in the presence of a dimerization molecule, associates with another switch domain. The association results in a functional coupling of a first entity linked to, e.g., fused to, a first switch domain, and a second entity linked to, e.g., fused to, a second switch domain. A first and second switch domain are collectively referred to as a dimerization switch. In embodiments, the first and second switch domains are the same as one another, e.g., they are polypeptides having the same primary amino acid sequence, and are referred to collectively as a homodimerization switch. In embodiments, the switch is intracellular. In embodiments, the switch domain is a polypeptide-based entity, e.g., FKBP (FK506 binding protein), and the dimerization molecule is small molecule, e.g., AP20187.

The terms "T-cell" and "T-lymphocyte" are interchangeable and used synonymously herein. Examples include but are not limited to naïve T cells ("lymphocyte progenitors"), central memory T cells, effector memory T cells, stem memory T cells ($T_{scm}$), iPSC-derived T cells, synthetic T cells or combinations thereof.

The term "TCR-associated signaling module" refers to a molecule having a cytoplasmic immunoreceptor tyrosine-based activation motif (ITAM) that is part of the TCR-CD3 complex. TCR-associated signaling modules include CDγε, CDδε and CD3ζζ.

"Therapeutic agents" as used herein refers to agents that are used to, for example, treat, inhibit, prevent, mitigate the effects of, reduce the severity of, reduce the likelihood of developing, slow the progression of and/or cure, a disease. Diseases targeted by the therapeutic agents include but are not limited to infectious diseases, carcinomas, sarcomas, lymphomas, leukemia, germ cell tumors, blastomas, antigens expressed on various immune cells, and antigens expressed on cells associated with various hematologic diseases, and/or inflammatory diseases.

"Therapeutic Controls" as used herein refers to an element used for controlling the activity of a CAR expressing cell. In some embodiments, therapeutic controls for controlling the activity of the CAR expressing cells of the invention comprise any one or more of truncated epidermal growth factor receptor (tEGFR), truncated epidermal growth factor receptor viii (tEGFRviii), truncated CD30 (tCD30), truncated BCMA (tBCMA), truncated CD19 (tCD19), thymidine kinase, cytosine deaminase, nitroreductase, xanthine-guanine phosphoribosyl transferase, human caspase 8, human caspase 9, inducible caspase 9, purine nucleoside phosphorylase, linamarase/linamarin/glucose oxidase, deoxyribonucleoside kinase, horseradish peroxidase (HRP)/indole-3-acetic (IAA), Gamma-glutamylcysteine synthetase, CD20/alphaCD20, CD34/thymidine kinase chimera, dox-depedent caspase-2, mutant thymidine kinase (HSV-TKSR39), AP1903/Fas system, a chimeric cytokine receptor (CCR), a selection marker, and combinations thereof.

The term "therapeutic effect" refers to a biological effect which can be manifested by various means, including but not limited to, e.g., decrease in tumor volume, a decrease in the number of cancer cells, a decrease in the number of metastases, an increase in life expectancy, decrease in cancer cell proliferation, decrease in cancer cell survival, decrease in the titer of the infectious agent, a decrease in colony counts of the infectious agent, amelioration of various physiological symptoms associated with a disease condition. A "therapeutic effect" can also be manifested by the ability of the peptides, polynucleotides, cells and antibodies in prevention of the occurrence of disease in the first place or in the prevention of relapse of the disease.

The term "therapeutically effective amount" as used herein refers to the amount of a pharmaceutical composition comprising one or more peptides as disclosed herein or a mutant, variant, analog or derivative thereof, to decrease at least one or more symptom of the disease or disorder, and relates to a sufficient amount of pharmacological composition to provide the desired effect. The phrase "therapeutically effective amount" as used herein means a sufficient amount of the composition to treat a disorder, at a reasonable benefit/risk ratio applicable to any medical treatment.

A therapeutically or prophylactically significant reduction in a symptom is, e.g. at least about 10%, at least about 20%, at least about 30%, at least about 40%, at least about 50%, at least about 60%, at least about 70%, at least about 80%, at least about 90%, at least about 100%, at least about 125%, at least about 150% or more in a measured parameter as compared to a control or non-treated subject or the state of the subject prior to administering the oligopeptides described herein. Measured or measurable parameters include clinically detectable markers of disease, for example, elevated or depressed levels of a biological marker, as well as parameters related to a clinically accepted scale of symptoms or markers for diabetes. It will be understood, however, that the total daily usage of the compositions and formulations as disclosed herein will be decided by the attending physician within the scope of sound medical judgment. The exact amount required will vary depending on factors such as the type of disease being treated, gender, age, and weight of the subject.

The term "TCR receptor fusion proteins or TFP" refers to a next generation CAR platform as described in WO 2016/187349 A1 which is incorporated herein by reference. In an embodiment, a TFP comprises an antibody moiety that specifically binds to a target antigen fused to a TCR chain such as CD3ε, CD3γ, CD3δ, TCRα or TCRβ. Exemplary TCR chains that can be used in the construction of TFP are represented by SEQ ID NOs: 944-945, 948, 949-950 and 958 and are provided in WO 2017/070608 A1 which is incorporated herein by reference. A TFP incorporating CD3ε chain is referred to as a CD3ε TFP. A TFP incorporating CD3γ chain is referred to as a CD3γ TFP. A TFP incorporating CD3δ chain is referred to as a CD3δ TFP. The TFP incorporating CD3ε, CD3γ or CD3δ chains are collectively referred to as CD3ε/γ/δ TFP. Exemplary TFPs incorporating different antigen binding domains (e.g., vL and vH fragments, ligands, receptors etc.) described in this disclosure and co-expressing an accessory module encoding NEMO-K277A are provided in SEQ ID NO: 1900-3123 (Table 13). The SEQ ID Nos, antigen binding domains and target antigens of these TFPs can be determined by referring to Table 12 as these TFP constructs have identical antigen binding domains to the first generation CAR constructs coexpressing NEMO-K277A shown in Table 12 and are numbered in identical order. However, the accessory module encoding NEMO-K277A is optional. TFP with the antigen binding domains (i.e., vL and vH fragments, ligands and receptors etc.) described in this disclosure can be constructed without NEMO-K277A. As such, this accessory module along with the upstream Furine-SGSG-F2A sequence can be deleted from the TFPs represented by SEQ ID NO: 1900-3123. Alternatively, the accessory module encoding NEMO-K277A can be replaced by accessory modules encoding other signaling proteins, such as hNEMO-K277A-deltaV249-K555, mNEMO-K270A, K13-opt, IKK2-S177E-S181E, or IKK1-S176E-S180E, and MyD88-L265P, FKBPx2-NEMO, NEMO-L600-FKBPx2, and CMV-141 etc.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a poly lysine compound, liposome, and the like. Examples of viral transfer vectors include, but are not limited to, adenoviral vectors, adena-associated virus vectors, retroviral vectors, lentiviral vectors, and the like.

"Transmembrane domain" (TMD) as used herein refers to the region of the CAR which crosses the plasma membrane. The transmembrane domain of the CAR of the invention is the transmembrane region of a transmembrane protein (for example Type I transmembrane proteins), an artificial hydrophobic sequence or a combination thereof. Other transmembrane domains will be apparent to those of skill in the art and may be used in connection with alternate embodiments of the invention. In some embodiments, the TMD encoded CAR comprising any of the backbones described herein comprises a transmembrane domain selected from the transmembrane domain of an alpha, beta or zeta chain of a T-cell receptor, CD3γ, CD3ε, CD3δ, CD28, CD45, CD4, CD5, CD8, CD9, CD16, CD22, CD33, CD37, CD64, CD80, CD86, CD134, CD137, CD154, KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), CD160, CD19, IL2R beta, IL2R gamma, IL7R a, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1(CD226), SLAMF4 (CD244, 2B4), CD84, CD96 (Tactile), CEACAM1, CRT AM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKp44, NKp30, NKp46, NKG2D, and/or NKG2C.

As used herein "Tri-functional T cell antigen coupler or Tri-TAC" refer to a next generation CAR platform described in WO 2015/117229 A1, which is incorporated herein by reference. Tri-TAC targeting different antigens can be constructed using the antigen binding domains (e.g., vL and vH fragments, scFv, vHH, ligands and receptors etc.) described in this disclosure using techniques known in the art. Furthermore, the different accessory modules (e.g., NEMO- K277A, mNEMO-K270A etc.) described in this disclosure can be expressed in the Tri-TAC expressing immune cells, e.g., T cells, e.g., CAR-T cells.

As used herein, the terms "treat," "treatment," "treating," or "amelioration" refer to therapeutic treatments, wherein the object is to reverse, alleviate, ameliorate, inhibit, slow down or stop the progression or severity of a condition associated with, a disease or disorder. The term "treating" includes reducing or alleviating at least one adverse effect or symptom of a condition, disease or disorder, such as cancer. Treatment is generally "effective" if one or more symptoms or clinical markers are reduced. Alternatively, treatment is "effective" if the progression of a disease is reduced or halted. That is, "treatment" includes not just the improvement of symptoms or markers, but also a cessation of at least slowing of progress or worsening of symptoms that would be expected in absence of treatment. Beneficial or desired clinical results include, but are not limited to, alleviation of one or more symptom(s), diminishment of extent of disease, stabilized (i.e., not worsening) state of disease, delay or slowing of disease progression, amelioration or palliation of the disease state, and remission (whether partial or total), whether detectable or undetectable. The term "treatment" of a disease also includes providing relief from the symptoms or side-effects of the disease (including palliative treatment). In some embodiments, treatment of cancer includes decreasing tumor volume, decreasing the number of cancer cells, inhibiting cancer metastases, increasing life expectancy, decreasing cancer cell proliferation, decreasing cancer cell survival, or amelioration of various physiological symptoms associated with the cancerous condition.

"Tumor," as used herein refers to all neoplastic cell growth and proliferation, whether malignant or benign, and all pre-cancerous and cancerous cells and tissues.

"Vector", "cloning vector" and "expression vector" as used herein refer to the vehicle by which a polynucleotide sequence (e.g. a foreign gene) can be introduced into a host cell, so as to transform the host and promote expression (e.g. transcription and translation) of the introduced sequence. Vectors include plasmids, phages, viruses, etc.

The term "zeta" or alternatively "zeta chain", "CD3-zeta" or "TCR-zeta" is defined as the protein provided as GenBan Ace. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain, or functional derivatives thereof, that are sufficient to functionally transmit an initial signal necessary for T cell activation. In one aspect the cytoplasmic domain of zeta comprises residues 52 through 164 of GenBank Ace. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO: 4853 (Table 6D).

The binding domain of the CAR is selected to bind to a desired epitope. For example, the epitope recognized by a CAR can be also determined from the epitope recognized by the scFv comprising the CAR. For example, since the antigen specific domain of the CAR CD8SP-MPL-161-(vL-vH)-Myc-BBz-T2A-PAC (SEQ ID NO: 1509 and SEQ ID NO: 5422) targeting MPL is comprised of scFv MPL-161-(vL-vH) (SEQ ID NO: 808 and SEQ ID NO: 4721), it is expected that the CAR would target the same epitope as the scFv and the parental antibody from which the scFv is derived. The epitope recognized by the scFv MPL-161-(vL-vH) (SEQ ID NO: 808 and SEQ ID NO: 4721) is provided in SEQ ID NO: 15160. The epitopes recognized by several scFv and/or their parental antibodies used in the construction of the CARs and backbones of this disclosure are known in the art. Alternatively, the epitope targeted by a CAR (including the CARs that are present as parat of backbones) can be determined by generating a series of mutants of its target antigen and testing the ability of the mutants to bind to the CAR-expressing cells. As an example, the epitope recognized by the CAR CD8SP-MPL-161-(vL-vH)-Myc-BBz-T2A-PAC targeting MPL can be determined by generating a panel of mutants of the MPL-ECD-GGSG-Nluc-AcV5 fusion construct (DNA SEQ ID NO: 1015 and PRT SEQ ID NO: 4928). The mutant constructs would be transfected into a suitable cell line (e.g., 293FT cells) and the supernatant containing the fusion protein collected and assayed for NLuc activity to assure that the different mutant MPL-ECD-GGSG-Nluc-AcV5 fusion proteins are being secreted in the supernatant. Subsequently, the fusion proteins would be tested for their ability to bind to cells (e.g., Jurkat cells or T cells) expressing the CD8SP-MPL-161-(vL-vH)-Myc-BBz-T2A-PAC CAR construct. The mutant that fails to bind to the CAR-expressing cells is a candidate for containing the epitope targeted by the MPL-specific CAR. An alternate approach to determine the epitope recognized by a particular CAR could include a functional competitive assay with different test antibodies. For example, T cells expressing the CD8SP-MPL-161-(vL-vH)-Myc-BBz-T2A-PAC CAR could be co-cultured with a cell line expressing MPL (e.g., HEL cells) in the absence and presence of increasing concentrations of different test MPL antibodies. In case the epitope recognized by a test MPL antibody overlaps with the epitope recognized by the CD8SP-MPL-161-(vL-vH)-Myc-BBz-T2A-PAC CAR, then the test antibody would be expected to block target-cell killing and cytokine production induced by T cells expressing the CD8SP-MPL-161-(vL-vH)-Myc-BBz-T2A-PAC CAR in a dose-dependent manner. A non-specific antibody of the same isotype as the test antibody would be included as a control and would be expected to have no effect on the target-cell killing and cytokine production induced by T cells expressing the CAR. Similarly, a specific CAR can be expressed in Jurkat-NFAT-EGFP cells and the ability of a test antibody to block EGFP induction by the CAR-expressing Jurkat-NFAT-GFP cells upon coculture with a target cell line can be used to determine whether the epitope recognized by the test antibody overlaps with the epitope recognized by the said CAR.

Also provided herein are compositions comprising a non-naturally occurring immune receptor, e.g., a CAR, and an accessory module (including NF-κB stimulatory molecules and selective NF-κB activators) and method of using same to treat diseases, including cancer. As described herein, specific combinations of conventional CARs (Table 1) and accessory modules as described in Table 2 are provided.

Table 1: Conventional CAR architectures. First generation conventional CARs (Conventional CAR I) have an intracellular signaling (ISD) domain (e.g. CD3z) and no costimulatory domain. The TCR fusion proteins (TFP) are another example of conventional CAR 1. Second generation conventional CARs (Conventional CAR 2 or CAR II) have one costimulatory domain (e.g. 41BB or CD28) and an intracellular signaling (ISD) domain (e.g. CD3z). Third generation conventional CARs (Conventional CAR 3 or CAR III) have two costimulatory domains (e.g. 41BB and CD28) and an intracellular signaling (ISD) domain (e.g. CD3z). Ab-TCRs are duel chain receptors and have been described in PCT/US2016/058305. cTCRs are single chain, one-and-half, or double chain receptors consisting of antigen binding domain derived from a vL and vH fragment that are fused to one or more TCR constant chain and result in activation of T cell signaling. Synthetic immune receptors are next generation CARs and are described in U.S. 62/429, 597 and WO 2018/102795 A1:

TABLE 1

| | Conventional CAR Architectures | | | | | | |
|---|---|---|---|---|---|---|---|
| 1 | CAR 1 or CAR I (including TFP) | ASD | HR | TMD | ISD | | |
| 2 | CAR 2 (CAR II) | ASD | HR | TMD | CSD | ISD | |
| 3 | CAR 3 (CAR III) | ASD | HR | TMD | CSD-I | CSD-II | ISD |
| 4 | Ab-TCR | vL-cL | TCRD(1) | 2A | vH-CH1 | TCRD (II) | |
| 5 | Double Chain cTCR/SIR-1 | vL | TCR-C(1) | 2A | vH | TCR-C (II) | |
| 6 | One & Half Chain cTCR/SIR-3 | | TCR-C(1) | 2A | ASD | TCR-C (II) | |

TABLE 2

Exemplary Backbones

| | | Accessory Module | | |
|---|---|---|---|---|
| Backbone No. | CAR Component | NAME | SEQ ID (DNA) | SEQ ID (PRT) |
| Backbone 1 | CAR I | K13-vFLIP | 972 | 4885 |
| Backbone 2 | CAR I | hNEMO-K277A | 979 | 4892 |
| Backbone 3 | CAR I | FKBPx2-hNEMO-K277A | 1006 | 4919 |
| Backbone 4 | CAR I | FKBPx2-hNEMO-L753(251) | 1007 | 4920 |
| Backbone 5 | CAR I | FKBPx2-hNEMO-L600(200) | 1008 | 4921 |
| Backbone 6 | CAR I | FKBPx2-RIP-ID | 1009 | 4922 |
| Backbone 7 | CAR I | IKK2-S177E-S181E | 1002 | 4915 |
| Backbone 8 | CAR I | IKK1-S176E-S180E | 1004 | 4917 |
| Backbone 9 | CAR I | MYD88-L265P | 1000 | 4913 |
| Backbone 10 | CAR I | TCL-1A | 1005 | 4918 |
| Backbone 11 | CAR I | IgSP-[hTRAC-opt2] | 1010 | 4923 |
| Backbone 12 | CAR I | IgSP-[hTRBC-opt2] | 1011 | 4924 |
| Backbone 13 | CAR II | K13-vFLIP | 972 | 4885 |
| Backbone 14 | CAR II | hNEMO-K277A | 979 | 4892 |
| Backbone 15 | CAR II | FKBPx2-hNEMO-K277A | 1006 | 4919 |
| Backbone 16 | CAR II | FKBPx2-hNEMO-L753(251) | 1007 | 4920 |
| Backbone 17 | CAR II | FKBPx2-hNEMO-L600(200) | 1008 | 4921 |
| Backbone 18 | CAR II | FKBPx2-RIP-ID | 1009 | 4922 |
| Backbone 19 | CAR II | IKK2-S177E-S181E | 1002 | 4915 |
| Backbone 20 | CAR II | IKK1-S176E-S180E | 1004 | 4917 |
| Backbone 21 | CAR II | MYD88-L265P | 1000 | 4913 |
| Backbone 22 | CAR II | TCL-1A | 1005 | 4918 |
| Backbone 23 | CAR II | IgSP-[hTRAC-opt2] | 1010 | 4923 |
| Backbone 24 | CAR II | IgSP-[hTRBC-opt2] | 1011 | 4924 |
| Backbone 25 | CAR III | K13-vFLIP | 972 | 4885 |
| Backbone 26 | CAR III | hNEMO-K277A | 979 | 4892 |
| Backbone 27 | CAR III | FKBPx2-hNEMO-K277A | 1006 | 4919 |
| Backbone 28 | CAR III | FKBPx2-hNEMO-L753(251) | 1007 | 4920 |
| Backbone 29 | CAR III | FKBPx2-hNEMO-L600(200) | 1008 | 4921 |
| Backbone 30 | CAR III | FKBPx2-RIP-ID | 1009 | 4922 |
| Backbone 31 | CAR III | IKK2-S177E-S181E | 1002 | 4915 |
| Backbone 32 | CAR III | IKK1-S176E-S180E | 1004 | 4917 |
| Backbone 33 | CAR III | MYD88-L265P | 1000 | 4913 |
| Backbone 34 | CAR III | TCL-1A | 1005 | 4918 |
| Backbone 35 | CAR III | IgSP-[hTRAC-opt2] | 1010 | 4923 |
| Backbone 36 | CAR III | IgSP-[hTRBC-opt2] | 1011 | 4924 |
| Backbone 37 | Ab-TCR | K13-vFLIP | 972 | 4885 |
| Backbone 38 | Ab-TCR | hNEMO-K277A | 979 | 4892 |
| Backbone 39 | Ab-TCR | FKBPx2-hNEMO-K277A | 1006 | 4919 |
| Backbone 40 | Ab-TCR | FKBPx2-hNEMO-L753(251) | 1007 | 4920 |
| Backbone 41 | Ab-TCR | FKBPx2-hNEMO-L600(200) | 1008 | 4921 |
| Backbone 42 | Ab-TCR | FKBPx2-RIP-ID | 1009 | 4922 |
| Backbone 43 | Ab-TCR | IKK2-S177E-S181E (IKK2-SS/EE) | 1002 | 4915 |
| Backbone 44 | Ab-TCR | IKK1-S176E-S180E IKK1-SS/EE) | 1004 | 4917 |
| Backbone 45 | Ab-TCR | MYD88-L265P | 1000 | 4913 |
| Backbone 46 | Ab-TCR | TCL-1A | 1005 | 4918 |
| Backbone 47 | Ab-TCR | IgSP-[hTRAC-opt2] | 1010 | 4923 |
| Backbone 48 | Ab-TCR | IgSP-[hTRBC-opt2] | 1011 | 4924 |
| Backbone 49 | DC-cTCR/SIR | K13-vFLIP | 972 | 4885 |
| Backbone 50 | DC-cTCR/SIR | hNEMO-K277A | 979 | 4892 |
| Backbone 51 | DC-cTCR/SIR | FKBPx2-hNEMO-K277A | 1006 | 4919 |
| Backbone 52 | DC-cTCR/SIR | FKBPx2-hNEMO-L753(251) | 1007 | 4920 |
| Backbone 53 | DC-cTCR/SIR | FKBPx2-hNEMO-L600(200) | 1008 | 4921 |
| Backbone 54 | DC-cTCR/SIR | FKBPx2-RIP-ID | 1009 | 4922 |
| Backbone 55 | DC-cTCR/SIR | IKK2-S177E-S181E | 1002 | 4915 |
| Backbone 56 | DC-cTCR/SIR | IKK1-S176E-S180E | 1004 | 4917 |
| Backbone 57 | DC-cTCR/SIR | MYD88-L265P | 1000 | 4913 |
| Backbone 58 | DC-cTCR/SIR | TCL-1A | 1005 | 4918 |
| Backbone 59 | DC-cTCR/SIR | IgSP-[hTRAC-opt2] | 1010 | 4923 |
| Backbone 60 | DC-cTCR/SIR | IgSP-[hTRBC-opt2] | 1011 | 4924 |
| Backbone 61 | OHC-cTCR/SIR | K13-vFLIP | 972 | 4885 |
| Backbone 62 | OHC-cTCR/SIR | hNEMO-K277A | 979 | 4892 |
| Backbone 63 | OHC-cTCR/SIR | FKBPx2-hNEMO-K277A | 1006 | 4919 |
| Backbone 64 | OHC-cTCR/SIR | FKBPx2-hNEMO-L753(251) | 1007 | 4920 |
| Backbone 65 | OHC-cTCR/SIR | FKBPx2-hNEMO-L600(200) | 1008 | 4921 |
| Backbone 66 | OHC-cTCR/SIR | FKBPx2-RIP-ID | 1009 | 4922 |
| Backbone 67 | OHC-cTCR/SIR | IKK2-S177E-S181E | 1002 | 4915 |
| Backbone 68 | OHC-cTCR/SIR | IKK1-S176E-S180E | 1004 | 4917 |
| Backbone 69 | OHC-cTCR/SIR | MYD88-L265P | 1000 | 4913 |
| Backbone 70 | OHC-cTCR/SIR | TCL-1A | 1005 | 4918 |
| Backbone 71 | OHC-cTCR/SIR | IgSP-[hTRAC-opt2] | 1010 | 4923 |
| Backbone 72 | OHC-cTCR/SIR | IgSP-[hTRBC-opt2] | 1011 | 4924 |

TABLE 6A

TARGET ANTIGENS, NAMES AND SEQ IDs OF vL
FRAGMENTS AND SEQ IDs of CDR1-3

| TARGET | NAME of vL | SEQ ID vL (DNA) | SEQ ID vL (PRT) | SEQ ID-vL CDR1 | SEQ ID-vL CDR2 | SEQ ID-vL CDR3 |
|---|---|---|---|---|---|---|
| ALK | Alk-48-vL | 7792 | 10553 | 13204 | 13510 | 13816 |
| ALK | Alk-58-vL | 7793 | 10554 | 13205 | 13511 | 13817 |
| Amyloid | Amyloid-158-vL | 7794 | 10555 | 13206 | 13512 | 13818 |
| BCMA | BCMA-ET-40-vL | 7795 | 10556 | 13207 | 13513 | 13819 |
| BCMA | BCMA-ET-54-vL | 7796 | 10557 | 13208 | 13514 | 13820 |
| BCMA | BCMA-huC12A3-vL | 7797 | 10558 | 13209 | 13515 | 13821 |
| BCMA | BCMA-J6M0-vL | 7798 | 10559 | 13210 | 13516 | 13822 |
| CCR4 | CCR4-humAb1567-vL | 7799 | 10560 | 13211 | 13517 | 13823 |
| CD123 | CD123-CSL362-vL | 7800 | 10561 | 13212 | 13518 | 13824 |
| CD138 | CD138-vL | 7801 | 10562 | 13213 | 13519 | 13825 |
| CD179b | CD179b-vL | 7802 | 10563 | 13214 | 13520 | 13826 |
| CD19 | CD19-4G7-vL | 7803 | 10564 | 13215 | 13521 | 13827 |
| CD19 | CD19Bu12-vL | 7804 | 10565 | 13216 | 13522 | 13828 |
| CD19 | CD19MM-vL | 7805 | 10566 | 13217 | 13523 | 13829 |
| CD19 | FMC63-vL | 7806 | 10567 | 13218 | 13524 | 13830 |
| CD19 | FMC63-[2]-vL | 7807 | 10568 | 13219 | 13525 | 13831 |
| CD19 | FMC63-[3]-vL | 7808 | 10569 | 13220 | 13526 | 13832 |
| CD19 | huFMC63-11-vL | 7809 | 10570 | 13221 | 13527 | 13833 |
| CD20 | CD20-2F2-vL | 7810 | 10571 | 13222 | 13528 | 13834 |
| CD20 | CD20-GA101-vL | 7811 | 10572 | 13223 | 13529 | 13835 |
| CD22 | CD22-h10F4-vL | 7812 | 10573 | 13224 | 13530 | 13836 |
| CD22 | CD22-H22Rhov2ACDRKA-vL | 7813 | 10574 | 13225 | 13531 | 13837 |
| CD22 | CD22m971-vL | 7814 | 10575 | 13226 | 13532 | 13838 |
| CD276 | CD276-17-vL | 7815 | 10576 | 13227 | 13533 | 13839 |
| CD30 | CD30-5F11-vL | 7816 | 10577 | 13228 | 13534 | 13840 |
| CD30 | CD30-Ac10-vL | 7817 | 10578 | 13229 | 13535 | 13841 |
| CD32 | CD32-Med9-vL | 7818 | 10579 | 13230 | 13536 | 13842 |
| CD324 | CD324-hSC10-17-vL | 7819 | 10580 | 13231 | 13537 | 13843 |
| CD324 | CD324-SC10-6-vL | 7820 | 10581 | 13232 | 13538 | 13844 |
| CD33 | CD33-huMyc9-vL | 7821 | 10582 | 13233 | 13539 | 13845 |
| CD33 | CD33-AF5-vL | 7822 | 10583 | 13234 | 13540 | 13846 |
| CD34 | CD34-hu4C7-[2]-vL | 7823 | 10584 | 13235 | 13541 | 13847 |
| CD34 | CD34-hu4C7-vL | 7824 | 10585 | 13236 | 13542 | 13848 |
| CD44v6 | CD44v6-Biwa8-vL | 7825 | 10586 | 13237 | 13543 | 13849 |
| CD5 | CD5-18-vL | 7826 | 10587 | 13238 | 13544 | 13850 |
| CD5 | CD5-9-vL | 7827 | 10588 | 13239 | 13545 | 13851 |
| CD70 | CD70-h1F6-vL | 7828 | 10589 | 13240 | 13546 | 13852 |
| CD79b | CD79b-2F2-vL | 7829 | 10590 | 13241 | 13547 | 13853 |
| CD79b | huMA79bv28-vL | 7830 | 10591 | 13242 | 13548 | 13854 |
| CDH17 | CDH17-PTA001A4-vL | 7831 | 10592 | 13243 | 13549 | 13855 |
| CDH19 | CDH19-16A4-vL | 7832 | 10593 | 13244 | 13550 | 13856 |
| CDH6 | CDH6-NOV710-vL | 7833 | 10594 | 13245 | 13551 | 13857 |
| CDH6 | CDH6-NOV712-vL | 7834 | 10595 | 13246 | 13552 | 13858 |
| CLEC5A | CLEC5A-3E12A2-vL | 7835 | 10596 | 13247 | 13553 | 13859 |
| CLEC5A | CLEC5A-8H8F5-vL | 7836 | 10597 | 13248 | 13554 | 13860 |
| CLL1 | CLL1-M26-vL | 7837 | 10598 | 13249 | 13555 | 13861 |
| CLL1 | CLL1-M32-vL | 7838 | 10599 | 13250 | 13556 | 13862 |
| CMVpp65/MHC class I | CMVpp65-F5-vL | 7839 | 10600 | 13251 | 13557 | 13863 |
| CS1 | huLuc63-vL | 7840 | 10601 | 13252 | 13558 | 13864 |
| CS1 | HuLuc64-[2]-vL | 7841 | 10602 | 13253 | 13559 | 13865 |
| CS1 | HuLuc64-vL | 7842 | 10603 | 13254 | 13560 | 13866 |
| CS1 | huLuc90-vL | 7843 | 10604 | 13255 | 13561 | 13867 |
| CSF2RA | CSF2RA-Ab1-vL | 7844 | 10605 | 13256 | 13562 | 13868 |
| CSF2RA | CSF2RA-Ab6-vL | 7845 | 10606 | 13257 | 13563 | 13869 |
| DLL3 | DLL3-hSC16-13-vL | 7846 | 10607 | 13258 | 13564 | 13870 |
| DLL3 | DLL3-hSC16-56-vL | 7847 | 10608 | 13259 | 13565 | 13871 |
| EBNA3c/MHC class I | EBNA3c-315-vL | 7848 | 10609 | 13260 | 13566 | 13872 |
| EGFR | Cetuximab-vL | 7849 | 10610 | 13261 | 13567 | 13873 |
| EGFR | Nimotuzumab-vL | 7850 | 10611 | 13262 | 13568 | 13874 |
| EGFRviii | EGFRviii-139-vL | 7851 | 10612 | 13263 | 13569 | 13875 |
| EGFRviii | EGFRviii-2173-vL | 7852 | 10613 | 13264 | 13570 | 13876 |
| EpCam1 | EpCam1-D5K5-vL | 7853 | 10614 | 13265 | 13571 | 13877 |
| EpCam1 | Epcam1-MM1-vL | 7854 | 10615 | 13266 | 13572 | 13878 |
| FITC | FITC-vL | 7855 | 10616 | 13267 | 13573 | 13879 |
| FLT3 | FLT3-NC7-vL | 7856 | 10617 | 13268 | 13574 | 13880 |
| HIV1-envelop | HIV1-N6-vL | 7857 | 10618 | 13269 | 13575 | 13881 |

TABLE 6A-continued

TARGET ANTIGENS, NAMES AND SEQ IDs OF vL
FRAGMENTS AND SEQ IDs of CDR1-3

| TARGET | NAME of vL | SEQ ID vL (DNA) | SEQ ID vL (PRT) | SEQ ID-vL CDR1 | SEQ ID-vL CDR2 | SEQ ID-vL CDR3 |
|---|---|---|---|---|---|---|
| glycoprotein | | | | | | |
| Folate Receptor 1 (FR1) | FR1-huMov19-vL | 7858 | 10619 | 13270 | 13576 | 13882 |
| GAD | GAD-G3H8-vL | 7859 | 10620 | 13271 | 13577 | 13883 |
| GD2 | GD2-hu14-18-vL | 7860 | 10621 | 13272 | 13578 | 13884 |
| GD2 | GD2-hu3F8-vL | 7861 | 10622 | 13273 | 13579 | 13885 |
| GD3 | GD3-KM-641-vL | 7862 | 10623 | 13274 | 13580 | 13886 |
| GFRa4 | GFRa4-P4-10-2-vL | 7863 | 10624 | 13275 | 13581 | 13887 |
| GFRa4 | GFRa4-P4-10-vL | 7864 | 10625 | 13276 | 13582 | 13888 |
| GFRa4 | GFRAlpha4-P4-6-vL | 7865 | 10626 | 13277 | 13583 | 13889 |
| GM1 | GMl-5B2-vL | 7866 | 10627 | 13278 | 13584 | 13890 |
| GM1 | GM1-7E5-vL | 7867 | 10628 | 13279 | 13585 | 13891 |
| gp100/MHC class I | gp100-G2D12-vL | 7868 | 10629 | 13280 | 13586 | 13892 |
| gp100/MHC class I | gp100-vL | 7869 | 10630 | 13281 | 13587 | 13893 |
| GPC3 | GPC3-4E5-vL | 7870 | 10631 | 13282 | 13588 | 13894 |
| gpNMB | gpNMB-115-vL | 7871 | 10632 | 13283 | 13589 | 13895 |
| GPRC5D | GPRC5D-ET150-18-vL | 7872 | 10633 | 13284 | 13590 | 13896 |
| GPRC5D | GPRC5D-ET150-5-vL | 7873 | 10634 | 13285 | 13591 | 13897 |
| Her2 | Her2-Hu4D5-vL | 7874 | 10635 | 13286 | 13592 | 13898 |
| HIV1-gag (77-85)/MHC | HIV1-E5-vL | 7875 | 10636 | 13287 | 13593 | 13899 |
| HIV1-envelop glycoprotein | HIV1-3BNC117-vL | 7876 | 10637 | 13288 | 13594 | 13900 |
| HIV1-envelop glycoprotein | HIV1-PGT-128-vL | 7877 | 10638 | 13289 | 13595 | 13901 |
| HIV1-envelop glycoprotein | HIV1-VR-C01-vL | 7878 | 10639 | 13290 | 13596 | 13902 |
| HIV1-envelop glycoprotein | HIV1-X5-vL | 7879 | 10640 | 13291 | 13597 | 13903 |
| HMW-MAA | HMW-MAA-hIND-vL | 7880 | 10641 | 13292 | 13598 | 13904 |
| HTLV1-TAX/MHC class I | TAX-T3E3-vL | 7881 | 10642 | 13293 | 13599 | 13905 |
| HTLV1-TAX/MHC class I | TAX-T3F2-vL | 7882 | 10643 | 13294 | 13600 | 13906 |
| IL11Ra | IL11Ra-8E2-vL | 7883 | 10644 | 13295 | 13601 | 13907 |
| IL13Ra2 | IL13Ra2-hu107-vL | 7884 | 10645 | 13296 | 13602 | 13908 |
| IL13Ra2 | IL13Ra2-Hu108-vL | 7885 | 10646 | 13297 | 13603 | 13909 |
| IL6R | IL6R-M83-vL | 7886 | 10647 | 13298 | 13604 | 13910 |
| Influenza A HA | FLU-MEDI-8852-vL | 7887 | 10648 | 13299 | 13605 | 13911 |
| KSHV-gH | YC15-vL | 7888 | 10649 | 13300 | 13606 | 13912 |
| KSHV-K8.1 | 4C3-vL | 7889 | 10650 | 13301 | 13607 | 13913 |
| L1CAM | L1CAM-9-3-HU3-vL | 7890 | 10651 | 13302 | 13608 | 13914 |
| LAMP1 | LAMP1-humab 1-2-vL | 7891 | 10652 | 13303 | 13609 | 13915 |
| LAMP1 | LAMP1-Mb4-vL | 7892 | 10653 | 13304 | 13610 | 13916 |
| LewisY | LewisY-huS193-vL | 7893 | 10654 | 13305 | 13611 | 13917 |
| Lym1 | Lym1-vL | 7894 | 10655 | 13306 | 13612 | 13918 |
| Lym2 | Lym2-vL | 7895 | 10656 | 13307 | 13613 | 13919 |
| MART1/MHC class I | MART1-CAG10-vL | 7896 | 10657 | 13308 | 13614 | 13920 |
| MART1/MHC class I | MART1-CLA12-vL | 7897 | 10658 | 13309 | 13615 | 13921 |
| Mesothelin | Mesothelin-m912-vL | 7898 | 10659 | 13310 | 13616 | 13922 |
| MPL (TPO-R) | MPL-111-vL | 7899 | 10660 | 13311 | 13617 | 13923 |
| MPL (TPO-R) | MPL-161-HL-vL | 7900 | 10661 | 13312 | 13618 | 13924 |
| MPL (TPO-R) | MPL-161-vL | 7901 | 10662 | 13313 | 13619 | 13925 |
| MPL (TPO-R) | MPL-175-vL | 7902 | 10663 | 13314 | 13620 | 13926 |
| MPL (TPO-R) | MPL-178-vL | 7903 | 10664 | 13315 | 13621 | 13927 |
| MPL (TPO-R) | MPL-huVB22Bw5-vL | 7904 | 10665 | 13316 | 13622 | 13928 |
| MPL (TPO-R) | MPL-12E10-vL | 7905 | 10666 | 13317 | 13623 | 13929 |
| MPL (TPO-R) | MPL-AB317-vL | 7906 | 10667 | 13318 | 13624 | 13930 |
| Muc1/MHC class I | MUC1-D6-M3A1-vL | 7907 | 10668 | 13319 | 13625 | 13931 |
| Muc1/MHC class I | Muc1-D6-M3B8-vL | 7908 | 10669 | 13320 | 13626 | 13932 |

TABLE 6A-continued

| | TARGET ANTIGENS, NAMES AND SEQ IDs OF vL FRAGMENTS AND SEQ IDs of CDR1-3 | | | | | |
|---|---|---|---|---|---|---|
| TARGET | NAME of vL | SEQ ID vL (DNA) | SEQ ID vL (PRT) | SEQ ID-vL CDR1 | SEQ ID-vL CDR2 | SEQ ID-vL CDR3 |
| Muc16 | Muc16-4H11-vL | 7909 | 10670 | 13321 | 13627 | 13933 |
| NKG2D | NKG2D-MS-vL | 7910 | 10671 | 13322 | 13628 | 13934 |
| NYBR1 | NYBR1-vL | 7911 | 10672 | 13323 | 13629 | 13935 |
| NY-ESO/MHC class I | NY-ESO-T1-vL | 7912 | 10673 | 13324 | 13630 | 13936 |
| PD1 | PD1-4H1-vL | 7913 | 10674 | 13325 | 13631 | 13937 |
| PD1 | PD1-5C4-vL | 7914 | 10675 | 13326 | 13632 | 13938 |
| PDL1 | PDL1-10A5-vL | 7915 | 10676 | 13327 | 13633 | 13939 |
| PDL1 | PDL1-Atezoli-vL | 7916 | 10677 | 13328 | 13634 | 13940 |
| PDL1 | PDL1-SP142-vL | 7917 | 10678 | 13329 | 13635 | 13941 |
| PR1/MHC class I | PR1-vL | 7918 | 10679 | 13330 | 13636 | 13942 |
| PSCA | PSCA-Ha14-117-vL | 7919 | 10680 | 13331 | 13637 | 13943 |
| PSCA | PSCA-Ha14-121-vL | 7920 | 10681 | 13332 | 13638 | 13944 |
| PSMA | PSMA-006-vL | 7921 | 10682 | 13333 | 13639 | 13945 |
| PSMA | PSMA-J591-vL | 7922 | 10683 | 13334 | 13640 | 13946 |
| PTK7 | PTK7-hSC6-23-vL | 7923 | 10684 | 13335 | 13641 | 13947 |
| PTK7 | PTK7-SC6-10-2-vL | 7924 | 10685 | 13336 | 13642 | 13948 |
| ROR1 | ROR1-4A5-vL | 7925 | 10686 | 13337 | 13643 | 13949 |
| ROR1 | ROR1-4C10-vL | 7926 | 10687 | 13338 | 13644 | 13950 |
| SLea | SLea-5B1-vL | 7927 | 10688 | 13339 | 13645 | 13951 |
| SLea | SLea-7E3-vL | 7928 | 10689 | 13340 | 13646 | 13952 |
| SSEA4 | SSEA4-vL | 7929 | 10690 | 13341 | 13647 | 13953 |
| TCRB1 | TCRB1-E09-vL | 7930 | 10691 | 13342 | 13648 | 13954 |
| TCRB1 | TCRB1-Jovi1-vL | 7931 | 10692 | 13343 | 13649 | 13955 |
| TCRB2 | TCRB2-CP01-D05-vL | 7932 | 10693 | 13344 | 13650 | 13956 |
| TCRB2 | TCRB2-CP01-E05-vL | 7933 | 10694 | 13345 | 13651 | 13957 |
| TCRgd | TCRgd-G5-4-vL | 7934 | 10695 | 13346 | 13652 | 13958 |
| TERT/MHC class I | TERT-3G3-T865-vL | 7935 | 10696 | 13347 | 13653 | 13959 |
| TERT/MHC class I | TERT-4A9-T540-vL | 7936 | 10697 | 13348 | 13654 | 13960 |
| TGFBR2 | TGFBR2-Ab1-vL | 7937 | 10698 | 13349 | 13655 | 13961 |
| TIM1 | TIM1-HVCR1-270-2-vL | 7938 | 10699 | 13350 | 13656 | 13962 |
| TIM1 | Tim1HVCR1-ARD5-vL | 7939 | 10700 | 13351 | 13657 | 13963 |
| TnAg | TnAg-vL | 7940 | 10701 | 13352 | 13658 | 13964 |
| Tn-Muc1 | Tn-Muc1-hu5E5-vL | 7941 | 10702 | 13353 | 13659 | 13965 |
| TROP2 | TROP2-ARA47-HV3KV3-vL | 7942 | 10703 | 13354 | 13660 | 13966 |
| TROP2 | TROP2-h7E6-SVG-vL | 7943 | 10704 | 13355 | 13661 | 13967 |
| TSHR | TSHR-5C9-vL | 7944 | 10705 | 13356 | 13662 | 13968 |
| TSHR | TSHR-K1-70-vL | 7945 | 10706 | 13357 | 13663 | 13969 |
| TSHR | TSHR-KB1-vL | 7946 | 10707 | 13358 | 13664 | 13970 |
| TSLRP | TSLRP-vL | 7947 | 10708 | 13359 | 13665 | 13971 |
| Tyrosinase/MHC class I | Tyro-B2-vL | 7948 | 10709 | 13360 | 13666 | 13972 |
| Tyrosinase/MHC class I | Tyro-Mc1-vL | 7949 | 10710 | 13361 | 13667 | 13973 |
| Tyrosinase/MHC class I | TA2-vL | 7950 | 10711 | 13362 | 13668 | 13974 |
| VEGFR3 | VEGFR3-Ab1-vL | 7951 | 10712 | 13363 | 13669 | 13975 |
| WT1/MHC class I | WT1-Ab13-vL | 7952 | 10713 | 13364 | 13670 | 13976 |
| WT1/MHC class I | WT1-Ab15-vL | 7953 | 10714 | 13365 | 13671 | 13977 |
| WT1/MHC class I | WT1-Ab1-vL | 7954 | 10715 | 13366 | 13672 | 13978 |
| WT1/MHC class I | WT1-Ab5-vL | 7955 | 10716 | 13367 | 13673 | 13979 |
| EBV-gp350 | EBV-gp350-vL | 7956 | 10717 | 13368 | 13674 | 13980 |
| CD123 | CD123-1172-vL | 7957 | 10718 | 13369 | 13675 | 13981 |
| CDH19 | CDH19-4B10-vL | 7958 | 10719 | 13370 | 13676 | 13982 |
| Folate Receptor Beta | FRbeta-m923-vL | 7959 | 10720 | 13371 | 13677 | 13983 |
| LHR | LHR-8B7-vL | 7960 | 10721 | 13372 | 13678 | 13984 |
| LHR | LHR-5F4-21-vL | 7961 | 10722 | 13373 | 13679 | 13985 |
| B7H4 | B7H4-hu22C10-vL | 7962 | 10723 | 13374 | 13680 | 13986 |
| B7H4 | B7H4-hu1D11-vL | 7963 | 10724 | 13375 | 13681 | 13987 |

TABLE 6A-continued

TARGET ANTIGENS, NAMES AND SEQ IDs OF vL
FRAGMENTS AND SEQ IDs of CDR1-3

| TARGET | NAME of vL | SEQ ID vL (DNA) | SEQ ID vL (PRT) | SEQ ID-vL CDR1 | SEQ ID-vL CDR2 | SEQ ID-vL CDR3 |
|---|---|---|---|---|---|---|
| IgE | IgE-omalizumab-vL | 7964 | 10725 | 13376 | 13682 | 13988 |
| CD23 | CD23-p5E8-vL | 7965 | 10726 | 13377 | 13683 | 13989 |
| GCC | GCC-5F9-vL | 7966 | 10727 | 13378 | 13684 | 13990 |
| GCC | GCC-Ab229-vL | 7967 | 10728 | 13379 | 13685 | 13991 |
| CD200R | CD200R-huDx182-vL | 7968 | 10729 | 13380 | 13686 | 13992 |
| AFP/MHC class I | AFP-61-vL | 7969 | 10730 | 13381 | 13687 | 13993 |
| AFP/MHC class I | AFP-76-vL | 7970 | 10731 | 13382 | 13688 | 13994 |
| AFP/MHC class I | AFP-79-vL | 7971 | 10732 | 13383 | 13689 | 13995 |
| BCMA | BCMA-ET-03-vL | 7972 | 10733 | 13384 | 13690 | 13996 |
| BCMA | BCMA-huC11.D5.3L1H3-vL | 7973 | 10734 | 13385 | 13691 | 13997 |
| BCMA | BCMA-huC13-F12-vL | 7974 | 10735 | 13386 | 13692 | 13998 |
| CD123 | CD123-DART-1-vL | 7975 | 10736 | 13387 | 13693 | 13999 |
| CD123 | CD123-DART-2-vL | 7976 | 10737 | 13388 | 13694 | 14000 |
| CD123 | CD123-I3RB18-vL | 7977 | 10738 | 13389 | 13695 | 14001 |
| CD123 | CD123-hu3E3-vL | 7978 | 10739 | 13390 | 13696 | 14002 |
| CD123 | CD123-9F6-vL | 7979 | 10740 | 13391 | 13697 | 14003 |
| CD123 | CD123-I3RB2-vL | 7980 | 10741 | 13392 | 13698 | 14004 |
| CD123 | CD123-1176-vL | 7981 | 10742 | 13393 | 13699 | 14005 |
| CD123 | CD123-8B11-vL | 7982 | 10743 | 13394 | 13700 | 14006 |
| CD123 | CD123-2B8-vL | 7983 | 10744 | 13395 | 13701 | 14007 |
| CD123 | CD123-9D7-vL | 7984 | 10745 | 13396 | 13702 | 14008 |
| CD123 | CD123-3B10-vL | 7985 | 10746 | 13397 | 13703 | 14009 |
| CD19 | CD19-MEDI-3649-vL | 7986 | 10747 | 13398 | 13704 | 14010 |
| CD19 | CD19-Medrex-24D1-vL | 7987 | 10748 | 13399 | 13705 | 14011 |
| CD19 | CD19-MOR0028-vL | 7988 | 10749 | 13400 | 13706 | 14012 |
| CD19 | CD19-HD37-H2L1-vL | 7989 | 10750 | 13401 | 13707 | 14013 |
| CD19 | CD19-huBly3-vL | 7990 | 10751 | 13402 | 13708 | 14014 |
| CD19 | CD19-huSJ25C1-vL | 7991 | 10752 | 13403 | 13709 | 14015 |
| CD19 | CD19-hB4-vL | 7992 | 10753 | 13404 | 13710 | 14016 |
| CD19 | CD19-hu-mROO5-1-vL | 7993 | 10754 | 13405 | 13711 | 14017 |
| CD19 | CD19-hA19-vL | 7994 | 10755 | 13406 | 13712 | 14018 |
| CD20 | CD20-Leu16-vL | 7995 | 10756 | 13407 | 13713 | 14019 |
| CD20 | CD20-11B8-vL | 7996 | 10757 | 13408 | 13714 | 14020 |
| CD20 | CD20-2C6-vL | 7997 | 10758 | 13409 | 13715 | 14021 |
| CD20 | CD20-2H7-vL | 7998 | 10759 | 13410 | 13716 | 14022 |
| CD20 | CD20-hA20-vL | 7999 | 10760 | 13411 | 13717 | 14023 |
| CD20 | CD20-BM-CA-1925-v4-vL | 8000 | 10761 | 13412 | 13718 | 14024 |
| CD20 | CD20-Ubli-v4-vL | 8001 | 10762 | 13413 | 13719 | 14025 |
| CD20 | CD20-h1F5-vL | 8002 | 10763 | 13414 | 13720 | 14026 |
| CD20 | CD20-7D8-vL | 8003 | 10764 | 13415 | 13721 | 14027 |
| CD20 | CD20-AME-33-vL | 8004 | 10765 | 13416 | 13722 | 14028 |
| CD33 | CD33-Boehr2800308-vL | 8005 | 10766 | 13417 | 13723 | 14029 |
| CD33 | CD33-Him3-4-vL | 8006 | 10767 | 13418 | 13724 | 14030 |
| CD33 | CD33-SGNh2H12-vL | 8007 | 10768 | 13419 | 13725 | 14031 |
| CD33 | CD33-15G15-33-vL | 8008 | 10769 | 13420 | 13726 | 14032 |
| CD33 | CD33-33H4-vL | 8009 | 10770 | 13421 | 13727 | 14033 |
| CD33 | CD33-9C3-2-vL | 8010 | 10771 | 13422 | 13728 | 14034 |
| CD99 | CD99-hu12E7-vL | 8011 | 10772 | 13423 | 13729 | 14035 |
| CLL1 | CLL1-21C9-L2H3-vL | 8012 | 10773 | 13424 | 13730 | 14036 |
| CLL1 | CLL1-6E7L4H1e-vL | 8013 | 10774 | 13425 | 13731 | 14037 |
| CLL1 | CLL1-hu1075-v1-vL | 8014 | 10775 | 13426 | 13732 | 14038 |
| CLL1 | CLL1-hu1075-v2-vL | 8015 | 10776 | 13427 | 13733 | 14039 |
| CS1 | CS1-PDL241-vL | 8016 | 10777 | 13428 | 13734 | 14040 |
| CS1 | CS1-Hu27A-vL | 8017 | 10778 | 13429 | 13735 | 14041 |
| CS1 | CS1-ScHu34C3-vL | 8018 | 10779 | 13430 | 13736 | 14042 |
| CS1 | CS1-Hu31-D2-vL | 8019 | 10780 | 13431 | 13737 | 14043 |
| CS1 | CS1-Luc34-vL | 8020 | 10781 | 13432 | 13738 | 14044 |
| CS1 | CS1-LucX2-vL | 8021 | 10782 | 13433 | 13739 | 14045 |
| FITC | FITC-4M-53-vL | 8022 | 10783 | 13434 | 13740 | 14046 |

TABLE 6A-continued

TARGET ANTIGENS, NAMES AND SEQ IDs OF vL
FRAGMENTS AND SEQ IDs of CDR1-3

| TARGET | NAME of vL | SEQ ID vL (DNA) | SEQ ID vL (PRT) | SEQ ID-vL CDR1 | SEQ ID-vL CDR2 | SEQ ID-vL CDR3 |
|---|---|---|---|---|---|---|
| FITC | FITC-E2-vL | 8023 | 10784 | 13435 | 13741 | 14047 |
| GPRC5D | GPRC5D-ET150-1-vL | 8024 | 10785 | 13436 | 13742 | 14048 |
| GPRC5D | GPRC5D-ET150-2-vL | 8025 | 10786 | 13437 | 13743 | 14049 |
| HLA-A2 | HLA-A2-3PB2-vL | 8026 | 10787 | 13438 | 13744 | 14050 |
| HPV16-E7/MHC class I | HPV16-7-8-vL | 8027 | 10788 | 13439 | 13745 | 14051 |
| HPV16-E7/MHC class I | HPV16-2-vL | 8028 | 10789 | 13440 | 13746 | 14052 |
| Tissue Factor 1 (TF1) | TF1-98-vL | 8029 | 10790 | 13441 | 13747 | 14053 |
| Tn-Muc1 | Tn-Muc1-5E5-vL | 8030 | 10791 | 13442 | 13748 | 14054 |
| Ig Kappa-Light Chain | Kappa-LC1-vL | 8031 | 10792 | 13443 | 13749 | 14055 |
| PTK7 | PTK7-7C8-vL | 8032 | 10793 | 13444 | 13750 | 14056 |
| PTK7 | PTK7-12C6a-vL | 8033 | 10794 | 13445 | 13751 | 14057 |
| CD19 | hCD19-EUK5-13-vL | 8034 | 10795 | 13446 | 13752 | 14058 |
| Ras/MHC class I | Ras-Ab2-vL | 8035 | 10796 | 13447 | 13753 | 14059 |
| Ras/MHC class I | Ras-Ab4-vL | 8036 | 10797 | 13448 | 13754 | 14060 |
| CLD18A2 | CLD18A2-43A11-vL | 8037 | 10798 | 13449 | 13755 | 14061 |
| CLD18A2 | CLD18A2-175D10-vL | 8038 | 10799 | 13450 | 13756 | 14062 |
| CD43 | CD43-huJL-1-257-10-vL | 8039 | 10800 | 13451 | 13757 | 14063 |
| CD69L | CD69L-DREG200-vL | 8040 | 10801 | 13452 | 13758 | 14064 |
| NY-ESO | NYESO-35-15-vL | 8041 | 10802 | 13453 | 13759 | 14065 |
| P-glycoprotein (MDR1) | Pgp-9F11-vL | 8042 | 10803 | 13454 | 13760 | 14066 |
| Streptag | Streptag-vL | 8043 | 10804 | 13455 | 13761 | 14067 |
| BCMA | BCMA-huC13-F12-L1H2-vL | 8044 | 10805 | 13456 | 13762 | 14068 |
| BCMA | BCMA-huC12A3-L3H3-vL | 8045 | 10806 | 13457 | 13763 | 14069 |
| MPL/TPO-R | Hu-161-2-vL | 8046 | 10807 | 13458 | 13764 | 14070 |
| P-glycoprotein (MDR1) | Pgp-MRK16-vL | 8047 | 10808 | 13459 | 13765 | 14071 |
| CD22 | CD22-5-vL | 8048 | 10809 | 13460 | 13766 | 14072 |
| CD22 | CD22-10-vL | 8049 | 10810 | 13461 | 13767 | 14073 |
| CD22 | CD22-31-vL | 8050 | 10811 | 13462 | 13768 | 14074 |
| CD22 | CD22-53-vL | 8051 | 10812 | 13463 | 13769 | 14075 |
| CD22 | CD22-65-vL | 8052 | 10813 | 13464 | 13770 | 14076 |
| CD19 | hu-FMC65-1-vL | 8053 | 10814 | 13465 | 13771 | 14077 |
| MPL/TPO-R | MPL-hu-175-2-vL | 8054 | 10815 | 13466 | 13772 | 14078 |
| MPL/TPO-R | MPL-hu-111-2-vL | 8055 | 10816 | 13467 | 13773 | 14079 |
| CD179a | CD179a-2460-B04-vL | 8056 | 10817 | 13468 | 13774 | 14080 |
| CD179a | CD179a-2462-E07-vL | 8057 | 10818 | 13469 | 13775 | 14081 |
| CD37 | CD37-TRU-HL-vL | 8058 | 10819 | 13470 | 13776 | 14082 |
| CD37 | huCD37-Boeh-vL | 8059 | 10820 | 13471 | 13777 | 14083 |
| CD70 | CD70-13D-vL | 8060 | 10821 | 13472 | 13778 | 14084 |
| CD70 | CD70-16D-vL | 8061 | 10822 | 13473 | 13779 | 14085 |
| CD70 | CD70-21D-vL | 8062 | 10823 | 13474 | 13780 | 14086 |
| CD70 | CD70-1G2D-vL | 8063 | 10824 | 13475 | 13781 | 14087 |
| CD70 | CD70-hu2H5-vL | 8064 | 10825 | 13476 | 13782 | 14088 |
| CD70 | CD70-69A7-vL | 8065 | 10826 | 13477 | 13783 | 14089 |
| CD70 | CD70-10B4-vL | 8066 | 10827 | 13478 | 13784 | 14090 |
| CD70 | CD70-24D-vL | 8067 | 10828 | 13479 | 13785 | 14091 |
| CD70 | CD70-25D-vL | 8068 | 10829 | 13480 | 13786 | 14092 |
| HIV1-envelop glycoprotein | HIV1-N49P6-vL | 8069 | 10830 | 13481 | 13787 | 14093 |
| HIV1-envelop glycoprotein | HIV1-N49P7-vL | 8070 | 10831 | 13482 | 13788 | 14094 |
| HIV1-envelop glycoprotein | HIV1-N49P11-vL | 8071 | 10832 | 13483 | 13789 | 14095 |
| HIV1-envelop glycoprotein | HIV1-N60P1-1 | 8072 | 10833 | 13484 | 13790 | 14096 |
| HIV1-envelop glycoprotein | HIV1-N60P25-vL | 8073 | 10834 | 13485 | 13791 | 14097 |
| HIV1-envelop glycoprotein | HIV1-N49P9-vL | 8074 | 10835 | 13486 | 13792 | 14098 |

TABLE 6A-continued

TARGET ANTIGENS, NAMES AND SEQ IDs OF vL
FRAGMENTS AND SEQ IDs of CDR1-3

| TARGET | NAME of vL | SEQ ID vL (DNA) | SEQ ID vL (PRT) | SEQ ID-vL CDR1 | SEQ ID-vL CDR2 | SEQ ID-vL CDR3 |
|---|---|---|---|---|---|---|
| HIV1-envelop glycoprotein | HIV1-N60P2-1-vL | 8075 | 10836 | 13487 | 13793 | 14099 |
| HIV1-envelop glycoprotein | HIV1-N60P31-1-vL | 8076 | 10837 | 13488 | 13794 | 14100 |
| HIV1-envelop glycoprotein | HIV1-N60P22-vL | 8077 | 10838 | 13489 | 13795 | 14101 |
| HIV1-envelop glycoprotein | HIV1-N60P38-vL | 8078 | 10839 | 13490 | 13796 | 14102 |
| HIV1-envelop glycoprotein | HIV1-N60P30-vL | 8079 | 10840 | 13491 | 13797 | 14103 |
| HIV1-envelop glycoprotein | HIV1-N60P36-vL | 8080 | 10841 | 13492 | 13798 | 14104 |
| HIV1-envelop glycoprotein | HIV1-N60P39-vL | 8081 | 10842 | 13493 | 13799 | 14105 |
| HIV1-envelop glycoprotein | HIV1-N6039-1-vL | 8082 | 10843 | 13494 | 13800 | 14106 |
| HIV1-envelop glycoprotein | HIV1-N60P47-vL | 8083 | 10844 | 13495 | 13801 | 14107 |
| HIV1-envelop glycoprotein | HIV1-N60P48-vL | 8084 | 10845 | 13496 | 13802 | 14108 |
| HIV1-envelop glycoprotein | HIV1-N60P51-vL | 8085 | 10846 | 13497 | 13803 | 14109 |
| HIV1-envelop glycoprotein | HIV1-N60P35-vL | 8086 | 10847 | 13498 | 13804 | 14110 |
| HIV1-envelop glycoprotein | HIV1-N60P37-vL | 8087 | 10848 | 13499 | 13805 | 14111 |
| Lym1 | Hu-Lym1-vL | 8088 | 10849 | 13500 | 13806 | 14112 |
| Lym2 | Hu-Lym2-vL | 8089 | 10850 | 13501 | 13807 | 14113 |
| BCMA | BCMA-USC1-vL | 8090 | 10851 | 13502 | 13808 | 14114 |
| BCMA | BCMA-USC2-vL | 8091 | 10852 | 13503 | 13809 | 14115 |
| BCMA | BCMA-USC3-vL | 8092 | 10853 | 13504 | 13810 | 14116 |
| BCMA | BCMA-USC4-vL | 8093 | 10854 | 13505 | 13811 | 14117 |
| BCMA | BCMA-USC5-vL | 8094 | 10855 | 13506 | 13812 | 14118 |
| BCMA | BCMA-USC6-vL | 8095 | 10856 | 13507 | 13813 | 14119 |
| BCMA | BCMA-USC7-vL | 8096 | 10857 | 13508 | 13814 | 14120 |
| CD43 | CD43-huJL-1-257-10-vL | 8097 | 10858 | 13509 | 13815 | 14121 |

TABLE 6B

TARGET ANTIGENS, NAMES AND SEQ IDS OF
vH FRAGMENTS AND SEQ IDs of CDR1-3

| TARGET | NAME of vH | SEQ ID vH (DNA) | SEQ ID vH (PRT) | SEQ ID-vH CDR1 | SEQ ID-vH CDR2 | SEQ ID-vH CDR3 |
|---|---|---|---|---|---|---|
| ALK | Alk-48-vH | 8098 | 10859 | 14122 | 14428 | 14734 |
| ALK | Alk-58-vH | 8099 | 10860 | 14123 | 14429 | 14735 |
| Amyloid | Amyloid-158-vH | 8100 | 10861 | 14124 | 14430 | 14736 |
| BCMA | BCMA-ET-40-vH | 8101 | 10862 | 14125 | 14431 | 14737 |
| BCMA | BCMA-ET-54-vH | 8102 | 10863 | 14126 | 14432 | 14738 |
| BCMA | BCMA-huC12A3-vH | 8103 | 10864 | 14127 | 14433 | 14739 |
| BCMA | BCMA-J6M0-vH | 8104 | 10865 | 14128 | 14434 | 14740 |
| CCR4 | CCR4-humAb1567-vH | 8105 | 10866 | 14129 | 14435 | 14741 |
| CD123 | CD123-CSL362-vH | 8106 | 10867 | 14130 | 14436 | 14742 |
| CD138 | CD138-vH | 8107 | 10868 | 14131 | 14437 | 14743 |
| CD179b | CD179b-vH | 8108 | 10869 | 14132 | 14438 | 14744 |
| CD19 | CD19-4G7-vH | 8109 | 10870 | 14133 | 14439 | 14745 |
| CD19 | CD19Bu12-vH | 8110 | 10871 | 14134 | 14440 | 14746 |
| CD19 | CD19Bu12-[2]-vH | 8111 | 10872 | 14135 | 14441 | 14747 |
| CD19 | CD19MM-vH | 8112 | 10873 | 14136 | 14442 | 14748 |
| CD19 | FMC63-vH | 8113 | 10874 | 14137 | 14443 | 14749 |
| CD19 | FMC-63-vH | 8114 | 10875 | 14138 | 14444 | 14750 |
| CD19 | huFMC63-11-vH | 8115 | 10876 | 14139 | 14445 | 14751 |
| CD20 | CD20-2F2-vH | 8116 | 10877 | 14140 | 14446 | 14752 |
| CD20 | CD20-GA101-vH | 8117 | 10878 | 14141 | 14447 | 14753 |
| CD22 | CD22-h10F4-vH | 8118 | 10879 | 14142 | 14448 | 14754 |
| CD22 | CD22- | 8119 | 10880 | 14143 | 14449 | 14755 |

TABLE 6B-continued

TARGET ANTIGENS, NAMES AND SEQ IDS OF
vH FRAGMENTS AND SEQ IDs of CDR1-3

| TARGET | NAME of vH | SEQ ID vH (DNA) | SEQ ID vH (PRT) | SEQ ID-vH CDR1 | SEQ ID-vH CDR2 | SEQ ID-vH CDR3 |
|---|---|---|---|---|---|---|
| | H22Rhov2ACDRKA-vH | | | | | |
| CD22 | CD22m971-vH | 8120 | 10881 | 14144 | 14450 | 14756 |
| CD276 | CD276-17-vH | 8121 | 10882 | 14145 | 14451 | 14757 |
| CD30 | CD30-5F11-vH | 8122 | 10883 | 14146 | 14452 | 14758 |
| CD30 | CD30-Ac10-vH | 8123 | 10884 | 14147 | 14453 | 14759 |
| CD32 | CD32-Med9-vH | 8124 | 10885 | 14148 | 14454 | 14760 |
| CD324 | CD324-hSC10-17-vH | 8125 | 10886 | 14149 | 14455 | 14761 |
| CD324 | CD324-SC10-6-vH | 8126 | 10887 | 14150 | 14456 | 14762 |
| CD33 | CD33-huMyc9-vH | 8127 | 10888 | 14151 | 14457 | 14763 |
| CD33 | CD33-AF5-vH | 8128 | 10889 | 14152 | 14458 | 14764 |
| CD34 | CD34-hu4C7-vH | 8129 | 10890 | 14153 | 14459 | 14765 |
| CD44v6 | CD44v6-Biwa8-vH | 8130 | 10891 | 14154 | 14460 | 14766 |
| CD5 | CD5-18-vH | 8131 | 10892 | 14155 | 14461 | 14767 |
| CD5 | CD5-9-vH | 8132 | 10893 | 14156 | 14462 | 14768 |
| CD70 | CD70-h1F6-vH | 8133 | 10894 | 14157 | 14463 | 14769 |
| CD79b | CD79b-2F2-vH | 8134 | 10895 | 14158 | 14464 | 14770 |
| CD79b | huMA79bv28-vH | 8135 | 10896 | 14159 | 14465 | 14771 |
| CDH17 | CDH17-PTA001A4-vH | 8136 | 10897 | 14160 | 14466 | 14772 |
| CDH19 | CDH19-16A4-vH | 8137 | 10898 | 14161 | 14467 | 14773 |
| CDH6 | CDH6-NOV710-vH | 8138 | 10899 | 14162 | 14468 | 14774 |
| CDH6 | CDH6-NOV712-vH | 8139 | 10900 | 14163 | 14469 | 14775 |
| CLEC5A | CLEC5A-3E12A2-vH | 8140 | 10901 | 14164 | 14470 | 14776 |
| CLEC5A | CLEC5A-8H8F5-vH | 8141 | 10902 | 14165 | 14471 | 14777 |
| CLL1 | CLL1-M26-vH | 8142 | 10903 | 14166 | 14472 | 14778 |
| CLL1 | CLL1-M32-vH | 8143 | 10904 | 14167 | 14473 | 14779 |
| CMVpp65/MHC class I | CMVpp65-F5-vH | 8144 | 10905 | 14168 | 14474 | 14780 |
| CS1 | huLuc63-vH | 8145 | 10906 | 14169 | 14475 | 14781 |
| CS1 | HuLuc64-vH | 8146 | 10907 | 14170 | 14476 | 14782 |
| CS1 | huLuc90-vH | 8147 | 10908 | 14171 | 14477 | 14783 |
| CSF2RA | CSF2RA-Ab1-vH | 8148 | 10909 | 14172 | 14478 | 14784 |
| CSF2RA | CSF2RA-Ab6-vH | 8149 | 10910 | 14173 | 14479 | 14785 |
| DLL3 | DLL3-hSC16-13-vH | 8150 | 10911 | 14174 | 14480 | 14786 |
| DLL3 | DLL3-hSC16-56-vH | 8151 | 10912 | 14175 | 14481 | 14787 |
| EBNA3c/MHC class I | EBNA3c-315-vH | 8152 | 10913 | 14176 | 14482 | 14788 |
| EGFR | Cetuximab-vH | 8153 | 10914 | 14177 | 14483 | 14789 |
| EGFR | Nimotuzumab-vH | 8154 | 10915 | 14178 | 14484 | 14790 |
| EGFRviii | EGFRviii-139-vH | 8155 | 10916 | 14179 | 14485 | 14791 |
| EGFRviii | EGFRviii-2173-vH | 8156 | 10917 | 14180 | 14486 | 14792 |
| EpCam1 | EpCam1-D5K5-vH | 8157 | 10918 | 14181 | 14487 | 14793 |
| EpCam1 | Epcam1-MM1-vH | 8158 | 10919 | 14182 | 14488 | 14794 |
| FITC | FITC-vH | 8159 | 10920 | 14183 | 14489 | 14795 |
| FLT3 | FLT3-NC7-vH | 8160 | 10921 | 14184 | 14490 | 14796 |
| HIV1-envelop glycoprotein | HIV1-N6-vH | 8161 | 10922 | 14185 | 14491 | 14797 |
| Folate Receptor 1 (FR1) | FRl-huMov19-vH | 8162 | 10923 | 14186 | 14492 | 14798 |
| GAD | GAD-G3H8-vH | 8163 | 10924 | 14187 | 14493 | 14799 |
| GD2 | GD2-hu14-18-vH | 8164 | 10925 | 14188 | 14494 | 14800 |
| GD2 | GD2-hu3F8-vH | 8165 | 10926 | 14189 | 14495 | 14801 |
| GD3 | GD3-KM-641-vH | 8166 | 10927 | 14190 | 14496 | 14802 |
| GFRa4 | GFRa4-P4-10-vH | 8167 | 10928 | 14191 | 14497 | 14803 |
| GFRa4 | GFRAlpha4-P4-6-vH | 8168 | 10929 | 14192 | 14498 | 14804 |
| GM1 | GM1-5B2-vH | 8169 | 10930 | 14193 | 14499 | 14805 |
| GM1 | GM1-7E5-vH | 8170 | 10931 | 14194 | 14500 | 14806 |
| gp100/MHC class I | gp100-G2D12-vH | 8171 | 10932 | 14195 | 14501 | 14807 |
| gp100/MHC class I | gp100-vH | 8172 | 10933 | 14196 | 14502 | 14808 |
| GPC3 | GPC3-4E5-vH | 8173 | 10934 | 14197 | 14503 | 14809 |
| gpNMB | gpNMB-115-vH | 8174 | 10935 | 14198 | 14504 | 14810 |
| GPRC5D | GPRC5D-ET150-18-vH | 8175 | 10936 | 14199 | 14505 | 14811 |
| GPRC5D | GPRC5D-ET150-5-vH | 8176 | 10937 | 14200 | 14506 | 14812 |
| Her2 | Her2-Hu4D5-vH | 8177 | 10938 | 14201 | 14507 | 14813 |
| HIV1-gag (77-85)/MHC | HIV1-E5-vH | 8178 | 10939 | 14202 | 14508 | 14814 |
| HIV1-envelop glycoprotein | HIV1-3BNC117-vH | 8179 | 10940 | 14203 | 14509 | 14815 |

TABLE 6B-continued

TARGET ANTIGENS, NAMES AND SEQ IDS OF
vH FRAGMENTS AND SEQ IDs of CDR1-3

| TARGET | NAME of vH | SEQ ID vH (DNA) | SEQ ID vH (PRT) | SEQ ID-vH CDR1 | SEQ ID-vH CDR2 | SEQ ID-vH CDR3 |
|---|---|---|---|---|---|---|
| HIV1-envelop glycoprotein | HIV1-PGT-128-vH | 8180 | 10941 | 14204 | 14510 | 14816 |
| HIV1-envelop glycoprotein | HIV1-VR-C01-vH | 8181 | 10942 | 14205 | 14511 | 14817 |
| HIV1-envelop glycoprotein | HIV1-X5-vH | 8182 | 10943 | 14206 | 14512 | 14818 |
| HMW-MAA | HMW-MAA-hIND-vH | 8183 | 10944 | 14207 | 14513 | 14819 |
| HTLV1-TAX/MHC class I | TAX-T3E3-vH | 8184 | 10945 | 14208 | 14514 | 14820 |
| HTLV1-TAX/MHC class I | TAX-T3F2-vH | 8185 | 10946 | 14209 | 14515 | 14821 |
| IL11Ra | IL11Ra-8E2-vH | 8186 | 10947 | 14210 | 14516 | 14822 |
| IL13Ra2 | IL13Ra2-hu107-vH | 8187 | 10948 | 14211 | 14517 | 14823 |
| IL13Ra2 | IL13Ra2-Hu108-vH | 8188 | 10949 | 14212 | 14518 | 14824 |
| IL6R | IL6R-M83-vH | 8189 | 10950 | 14213 | 14519 | 14825 |
| Influenza A HA | FLU-MEDI-8852-vH | 8190 | 10951 | 14214 | 14520 | 14826 |
| KSHV-gH | YC15-vH | 8191 | 10952 | 14215 | 14521 | 14827 |
| KSHV-K8.1 | 4C3-vH | 8192 | 10953 | 14216 | 14522 | 14828 |
| L1CAM | L1CAM-9-3-HU3-vH | 8193 | 10954 | 14217 | 14523 | 14829 |
| LAMP1 | LAMP1-humab1-2-vH | 8194 | 10955 | 14218 | 14524 | 14830 |
| LAMP1 | LAMP1-Mb4-vH | 8195 | 10956 | 14219 | 14525 | 14831 |
| LewisY | LewisY-huS193-vH | 8196 | 10957 | 14220 | 14526 | 14832 |
| Lym1 | Lym1-vH | 8197 | 10958 | 14221 | 14527 | 14833 |
| Lym2 | Lym2-vH | 8198 | 10959 | 14222 | 14528 | 14834 |
| MART1/MHC class I | MART1-CAG10-vH | 8199 | 10960 | 14223 | 14529 | 14835 |
| MART1/MHC class I | MART1-CLA12-vH | 8200 | 10961 | 14224 | 14530 | 14836 |
| Mesothelin | Mesothelin-m912-[2]-vH | 8201 | 10962 | 14225 | 14531 | 14837 |
| Mesothelin | Mesothelin-m912-vH | 8202 | 10963 | 14226 | 14532 | 14838 |
| MPL (TPO-R) | MPL-111-vH | 8203 | 10964 | 14227 | 14533 | 14839 |
| MPL (TPO-R) | MPL-161-HL-vH | 8204 | 10965 | 14228 | 14534 | 14840 |
| MPL (TPO-R) | MPL-161-vH | 8205 | 10966 | 14229 | 14535 | 14841 |
| MPL (TPO-R) | MPL-175-vH | 8206 | 10967 | 14230 | 14536 | 14842 |
| MPL (TPO-R) | MPL-178-vH | 8207 | 10968 | 14231 | 14537 | 14843 |
| MPL (TPO-R) | MPL-huVB22Bw5-vH | 8208 | 10969 | 14232 | 14538 | 14844 |
| MPL (TPO-R) | MPL-12E10-vH | 8209 | 10970 | 14233 | 14539 | 14845 |
| MPL (TPO-R) | MPL-AB317-vH | 8210 | 10971 | 14234 | 14540 | 14846 |
| Muc1/MHC class I | MUC1-D6-M3A1-vH | 8211 | 10972 | 14235 | 14541 | 14847 |
| Muc1/MHC class I | Muc1-D6-M3B8-vH | 8212 | 10973 | 14236 | 14542 | 14848 |
| Muc16 | Muc16-4H11-vH | 8213 | 10974 | 14237 | 14543 | 14849 |
| NKG2D | NKG2D-MS-vH | 8214 | 10975 | 14238 | 14544 | 14850 |
| NYBR1 | NYBR1-vH | 8215 | 10976 | 14239 | 14545 | 14851 |
| NY-ESO/MHC class I | NY-ESO-T1-vH | 8216 | 10977 | 14240 | 14546 | 14852 |
| NY-ESO/MHC class I | NY-ESO-T2-vH | 8217 | 10978 | 14241 | 14547 | 14853 |
| PD1 | PD1-4H1-vH | 8218 | 10979 | 14242 | 14548 | 14854 |
| PD1 | PD1-5C4-vH | 8219 | 10980 | 14243 | 14549 | 14855 |
| PDL1 | PDL1-Atezoli-vH | 8220 | 10981 | 14244 | 14550 | 14856 |
| PDL1 | PDL1-SP142-vH | 8221 | 10982 | 14245 | 14551 | 14857 |
| PR1/MHC class I | PR1-vH | 8222 | 10983 | 14246 | 14552 | 14858 |
| PSCA | PSCA-Ha14-117-vH | 8223 | 10984 | 14247 | 14553 | 14859 |
| PSCA | PSCA-Ha14-121-vH | 8224 | 10985 | 14248 | 14554 | 14860 |
| PSMA | PSMA-006-vH | 8225 | 10986 | 14249 | 14555 | 14861 |
| PSMA | PSMA-J591-vH | 8226 | 10987 | 14250 | 14556 | 14862 |
| PTK7 | PTK7-hSC6-23-vH | 8227 | 10988 | 14251 | 14557 | 14863 |
| PTK7 | PTK7-SC6-10-2-vH | 8228 | 10989 | 14252 | 14558 | 14864 |
| ROR1 | ROR1-4A5-vH | 8229 | 10990 | 14253 | 14559 | 14865 |
| ROR1 | ROR1-4C10-vH | 8230 | 10991 | 14254 | 14560 | 14866 |
| SLea | SLea-5B1-vH | 8231 | 10992 | 14255 | 14561 | 14867 |
| SLea | SLea-7E3-vH | 8232 | 10993 | 14256 | 14562 | 14868 |
| SSEA4 | SSEA4-vH | 8233 | 10994 | 14257 | 14563 | 14869 |

TABLE 6B-continued

TARGET ANTIGENS, NAMES AND SEQ IDS OF
vH FRAGMENTS AND SEQ IDs of CDR1-3

| TARGET | NAME of vH | SEQ ID vH (DNA) | SEQ ID vH (PRT) | SEQ ID-vH CDR1 | SEQ ID-vH CDR2 | SEQ ID-vH CDR3 |
|---|---|---|---|---|---|---|
| TCRB1 | TCRB1-E09-vH | 8234 | 10995 | 14258 | 14564 | 14870 |
| TCRB1 | TCRB1-Jovi1-vH | 8235 | 10996 | 14259 | 14565 | 14871 |
| TCRB2 | TCRB2-CP01-D05-vH | 8236 | 10997 | 14260 | 14566 | 14872 |
| TCRB2 | TCRB2-CP01-E05-vH | 8237 | 10998 | 14261 | 14567 | 14873 |
| TCRgd | TCRgd-G5-4-vH | 8238 | 10999 | 14262 | 14568 | 14874 |
| TERT/MHC class I | TERT-3G3-T865-vH | 8239 | 11000 | 14263 | 14569 | 14875 |
| TERT/MHC class I | TERT-4A9-T540-vH | 8240 | 11001 | 14264 | 14570 | 14876 |
| TGFBR2 | TGFBR2-Ab1-vH | 8241 | 11002 | 14265 | 14571 | 14877 |
| TIM1 | TIM1-HVCR1-270-2-vH | 8242 | 11003 | 14266 | 14572 | 14878 |
| TIM1 | Tim1HVCR1-ARD5-vH | 8243 | 11004 | 14267 | 14573 | 14879 |
| TnAg | TnAg-vH | 8244 | 11005 | 14268 | 14574 | 14880 |
| Tn-Muc1 | Tn-Muc1-hu5E5-vH | 8245 | 11006 | 14269 | 14575 | 14881 |
| TROP2 | TROP2-ARA47-HV3KV3-vH | 8246 | 11007 | 14270 | 14576 | 14882 |
| TROP2 | TROP2-h7E6-SVG-vH | 8247 | 11008 | 14271 | 14577 | 14883 |
| TSHR | TSHR-5C9-vH | 8248 | 11009 | 14272 | 14578 | 14884 |
| TSHR | TSHR-K1-70-vH | 8249 | 11010 | 14273 | 14579 | 14885 |
| TSHR | TSHR-KB1-vH | 8250 | 11011 | 14274 | 14580 | 14886 |
| TSLRP | TSLRP-vH | 8251 | 11012 | 14275 | 14581 | 14887 |
| Tyrosinase/MHC class I | Tyro-B2-vH | 8252 | 11013 | 14276 | 14582 | 14888 |
| Tyrosinase/MHC class I | Tyro-Mc1-vH | 8253 | 11014 | 14277 | 14583 | 14889 |
| Tyrosinase/MHC class I | TA2-vH | 8254 | 11015 | 14278 | 14584 | 14890 |
| VEGFR3 | VEGFR3-Ab1-vH | 8255 | 11016 | 14279 | 14585 | 14891 |
| WT1/MHC class I | WT1-Ab13-vH | 8256 | 11017 | 14280 | 14586 | 14892 |
| WT1/MHC class I | WT1-Ab15-vH | 8257 | 11018 | 14281 | 14587 | 14893 |
| WT1/MHC class I | WT1-Ab1-vH | 8258 | 11019 | 14282 | 14588 | 14894 |
| WT1/MHC class I | WT1-Ab5-[2]-vH | 8259 | 11020 | 14283 | 14589 | 14895 |
| WT1/MHC class I | WT1-Ab5-vH | 8260 | 11021 | 14284 | 14590 | 14896 |
| EBV-gp350 | EBV-gp350-vH | 8261 | 11022 | 14285 | 14591 | 14897 |
| CD123 | CD123-1172-vH | 8262 | 11023 | 14286 | 14592 | 14898 |
| CDH19 | CDH19-4B10-vH | 8263 | 11024 | 14287 | 14593 | 14899 |
| Folate Receptor Beta | FRbeta-m923-vH | 8264 | 11025 | 14288 | 14594 | 14900 |
| LHR | LHR-8B7-vH | 8265 | 11026 | 14289 | 14595 | 14901 |
| LHR | LHR-5F4-21-vH | 8266 | 11027 | 14290 | 14596 | 14902 |
| B7H4 | B7H4-hu22C10-vH | 8267 | 11028 | 14291 | 14597 | 14903 |
| B7H4 | B7H4-hu1D11-vH | 8268 | 11029 | 14292 | 14598 | 14904 |
| IgE | IgE-omalizumab-vH | 8269 | 11030 | 14293 | 14599 | 14905 |
| CD23 | CD23-p5E8-vH | 8270 | 11031 | 14294 | 14600 | 14906 |
| GCC | GCC-5F9-vH | 8271 | 11032 | 14295 | 14601 | 14907 |
| GCC | GCC-Ab229-vH | 8272 | 11033 | 14296 | 14602 | 14908 |
| CD200R | CD200R-huDx182-vH | 8273 | 11034 | 14297 | 14603 | 14909 |
| AFP/MHC class I | AFP-61-vH | 8274 | 11035 | 14298 | 14604 | 14910 |
| AFP/MHC class I | AFP-76-vH | 8275 | 11036 | 14299 | 14605 | 14911 |
| AFP/MHC class I | AFP-79-vH | 8276 | 11037 | 14300 | 14606 | 14912 |
| BCMA | BCMA-ET-03-vH | 8277 | 11038 | 14301 | 14607 | 14913 |
| BCMA | BCMA-huC11.D5.3L1H3-vH | 8278 | 11039 | 14302 | 14608 | 14914 |
| BCMA | BCMA-huC13-F12-vH | 8279 | 11040 | 14303 | 14609 | 14915 |
| CD123 | CD123-DART-1-vH | 8280 | 11041 | 14304 | 14610 | 14916 |
| CD123 | CD123-DART-2-vH | 8281 | 11042 | 14305 | 14611 | 14917 |
| CD123 | CD123-13RB18-vH | 8282 | 11043 | 14306 | 14612 | 14918 |
| CD123 | CD123-hu3E3-vH | 8283 | 11044 | 14307 | 14613 | 14919 |

TABLE 6B-continued

TARGET ANTIGENS, NAMES AND SEQ IDS OF
vH FRAGMENTS AND SEQ IDs of CDR1-3

| TARGET | NAME of vH | SEQ ID vH (DNA) | SEQ ID vH (PRT) | SEQ ID-vH CDR1 | SEQ ID-vH CDR2 | SEQ ID-vH CDR3 |
|---|---|---|---|---|---|---|
| CD123 | CD123-9F6-vH | 8284 | 11045 | 14308 | 14614 | 14920 |
| CD123 | CD123-I3RB2-vH | 8285 | 11046 | 14309 | 14615 | 14921 |
| CD123 | CD123-1176-vH | 8286 | 11047 | 14310 | 14616 | 14922 |
| CD123 | CD123-8B11-vH | 8287 | 11048 | 14311 | 14617 | 14923 |
| CD123 | CD123-2B8-vH | 8288 | 11049 | 14312 | 14618 | 14924 |
| CD123 | CD123-9D7-vH | 8289 | 11050 | 14313 | 14619 | 14925 |
| CD123 | CD123-3B10-vH | 8290 | 11051 | 14314 | 14620 | 14926 |
| CD19 | CD19-MEDI-3649-vH | 8291 | 11052 | 14315 | 14621 | 14927 |
| CD19 | CD19-Medrex-24D1-vH | 8292 | 11053 | 14316 | 14622 | 14928 |
| CD19 | CD19-MOR0028-vH | 8293 | 11054 | 14317 | 14623 | 14929 |
| CD19 | CD19-HD37-H2L1-vH | 8294 | 11055 | 14318 | 14624 | 14930 |
| CD19 | CD19-huBly3-vH | 8295 | 11056 | 14319 | 14625 | 14931 |
| CD19 | CD19-huSJ25C1-vH | 8296 | 11057 | 14320 | 14626 | 14932 |
| CD19 | CD19-hB4-vH | 8297 | 11058 | 14321 | 14627 | 14933 |
| CD19 | CD19-hu-mROO5-1-vH | 8298 | 11059 | 14322 | 14628 | 14934 |
| CD19 | CD19-hA19-vH | 8299 | 11060 | 14323 | 14629 | 14935 |
| CD20 | CD20-Leu16-vH | 8300 | 11061 | 14324 | 14630 | 14936 |
| CD20 | CD20-11B8-vH | 8301 | 11062 | 14325 | 14631 | 14937 |
| CD20 | CD20-2C6-vH | 8302 | 11063 | 14326 | 14632 | 14938 |
| CD20 | CD20-2H7-vH | 8303 | 11064 | 14327 | 14633 | 14939 |
| CD20 | CD20-hA20-vH | 8304 | 11065 | 14328 | 14634 | 14940 |
| CD20 | CD20-BM-CA-1925-v4-vH | 8305 | 11066 | 14329 | 14635 | 14941 |
| CD20 | CD20-Ubli-v4-vH | 8306 | 11067 | 14330 | 14636 | 14942 |
| CD20 | CD20-h1F5-vH | 8307 | 11068 | 14331 | 14637 | 14943 |
| CD20 | CD20-7D8-vH | 8308 | 11069 | 14332 | 14638 | 14944 |
| CD20 | CD20-AME-33-vH | 8309 | 11070 | 14333 | 14639 | 14945 |
| CD33 | CD33-Boehr2800308-vH | 8310 | 11071 | 14334 | 14640 | 14946 |
| CD33 | CD33-Him3-4-vH | 8311 | 11072 | 14335 | 14641 | 14947 |
| CD33 | CD33-SGNh2H12-vH | 8312 | 11073 | 14336 | 14642 | 14948 |
| CD33 | CD33-15G15-33-vH | 8313 | 11074 | 14337 | 14643 | 14949 |
| CD33 | CD33-33H4-vH | 8314 | 11075 | 14338 | 14644 | 14950 |
| CD33 | CD33-33H4-2-vH | 8315 | 11076 | 14339 | 14645 | 14951 |
| CD33 | CD33-9C3-2-vH | 8316 | 11077 | 14340 | 14646 | 14952 |
| CD99 | CD99-hu12E7-vH | 8317 | 11078 | 14341 | 14647 | 14953 |
| CLL1 | CLL1-21C9-L2H3-vH | 8318 | 11079 | 14342 | 14648 | 14954 |
| CLL1 | CLL1-6E7L4H1e-vH | 8319 | 11080 | 14343 | 14649 | 14955 |
| CLL1 | CLL1-hu1075-v1-vH | 8320 | 11081 | 14344 | 14650 | 14956 |
| CLL1 | CLL1-hu1075-v2-vH | 8321 | 11082 | 14345 | 14651 | 14957 |
| CS1 | CS1-PDL241-vH | 8322 | 11083 | 14346 | 14652 | 14958 |
| CS1 | CS1-Hu27A-vH | 8323 | 11084 | 14347 | 14653 | 14959 |
| CS1 | CS1-ScHu34C3-vH | 8324 | 11085 | 14348 | 14654 | 14960 |
| CS1 | CS1-Hu31-D2-vH | 8325 | 11086 | 14349 | 14655 | 14961 |
| CS1 | CS1-Luc34-vH | 8326 | 11087 | 14350 | 14656 | 14962 |
| CS1 | CS1-LucX2-vH | 8327 | 11088 | 14351 | 14657 | 14963 |
| FITC | FITC-4M-53-vH | 8328 | 11089 | 14352 | 14658 | 14964 |
| FITC | FITC-E2-vH | 8329 | 11090 | 14353 | 14659 | 14965 |
| GPRC5D | GPRC5D-ET150-1-vH | 8330 | 11091 | 14354 | 14660 | 14966 |
| GPRC5D | GPRC5D-ET150-2-vH | 8331 | 11092 | 14355 | 14661 | 14967 |
| HLA-A2 | HLA-A2-3PB2-vH | 8332 | 11093 | 14356 | 14662 | 14968 |
| HPV16-E7/MHC class I | HPV16-7-8-vH | 8333 | 11094 | 14357 | 14663 | 14969 |
| HPV16-E7/MHC class I | HPV16-2-vH | 8334 | 11095 | 14358 | 14664 | 14970 |
| Tissue Factor 1 (TF1) | TF1-98-vH | 8335 | 11096 | 14359 | 14665 | 14971 |
| Tn-Muc1 | Tn-Muc1-5E5-vH | 8336 | 11097 | 14360 | 14666 | 14972 |
| Ig Kappa-Light Chain | Kappa-LC1-vH | 8337 | 11098 | 14361 | 14667 | 14973 |
| PTK7 | PTK7-7C8-vH | 8338 | 11099 | 14362 | 14668 | 14974 |
| PTK7 | PTK7-12C6a-vH | 8339 | 11100 | 14363 | 14669 | 14975 |
| CD19 | hCD19-EUK5-13-vH | 8340 | 11101 | 14364 | 14670 | 14976 |
| Ras/MHC class I | Ras-Ab2-vH | 8341 | 11102 | 14365 | 14671 | 14977 |
| Ras/MHC class I | Ras-Ab4-vH | 8342 | 11103 | 14366 | 14672 | 14978 |

TABLE 6B-continued

TARGET ANTIGENS, NAMES AND SEQ IDS OF
vH FRAGMENTS AND SEQ IDs of CDR1-3

| TARGET | NAME of vH | SEQ ID vH (DNA) | SEQ ID vH (PRT) | SEQ ID-vH CDR1 | SEQ ID-vH CDR2 | SEQ ID-vH CDR3 |
|---|---|---|---|---|---|---|
| CLD18A2 | CLD18A2-43A11-vH | 8343 | 11104 | 14367 | 14673 | 14979 |
| CLD18A2 | CLD18A2-175D10-vH | 8344 | 11105 | 14368 | 14674 | 14980 |
| CD43 | CD43-huJL-1-257-10-vH | 8345 | 11106 | 14369 | 14675 | 14981 |
| CD69L | CD69L-DREG200-vH | 8346 | 11107 | 14370 | 14676 | 14982 |
| NY-ESO | NYESO-35-15-vH | 8347 | 11108 | 14371 | 14677 | 14983 |
| P-glycoprotein (MDR1) | Pgp-9F11-vH | 8348 | 11109 | 14372 | 14678 | 14984 |
| Streptag | Streptag-vH | 8349 | 11110 | 14373 | 14679 | 14985 |
| BCMA | BCMA-huC13-F12-L1H2-v2-vH | 8350 | 11111 | 14374 | 14680 | 14986 |
| BCMA | BCMA-huC12A3-L3H3-v2-vH | 8351 | 11112 | 14375 | 14681 | 14987 |
| MPL/TPO-R | Hu-161-2-vH | 8352 | 11113 | 14376 | 14682 | 14988 |
| P-glycoprotein (MDR1) | Pgp-MRK16-vH | 8353 | 11114 | 14377 | 14683 | 14989 |
| CD22 | CD22-5-vH | 8354 | 11115 | 14378 | 14684 | 14990 |
| CD22 | CD22-10-vH | 8355 | 11116 | 14379 | 14685 | 14991 |
| CD22 | CD22-31-vH | 8356 | 11117 | 14380 | 14686 | 14992 |
| CD22 | CD22-53-vH | 8357 | 11118 | 14381 | 14687 | 14993 |
| CD22 | CD22-65-vH | 8358 | 11119 | 14382 | 14688 | 14994 |
| CD19 | hu-FMC65-1-vH | 8359 | 11120 | 14383 | 14689 | 14995 |
| MPL/TPO-R | MPL-hu-175-2-vH | 8360 | 11121 | 14384 | 14690 | 14996 |
| MPL/TPO-R | MPL-hu-111-2-vH | 8361 | 11122 | 14385 | 14691 | 14997 |
| CD179a | CD179a-2460-B04-vH | 8362 | 11123 | 14386 | 14692 | 14998 |
| CD179a | CD179a-2462-E07-vH | 8363 | 11124 | 14387 | 14693 | 14999 |
| CD37 | CD37-TRU-HL-vH | 8364 | 11125 | 14388 | 14694 | 15000 |
| CD37 | huCD37-Boeh-vH | 8365 | 11126 | 14389 | 14695 | 15001 |
| CD70 | CD70-13D-vH | 8366 | 11127 | 14390 | 14696 | 15002 |
| CD70 | CD70-16D-vH | 8367 | 11128 | 14391 | 14697 | 15003 |
| CD70 | CD70-21D-vH | 8368 | 11129 | 14392 | 14698 | 15004 |
| CD70 | CD70-1G2D-vH | 8369 | 11130 | 14393 | 14699 | 15005 |
| CD70 | CD70-hu-2H5-vH | 8370 | 11131 | 14394 | 14700 | 15006 |
| CD70 | CD70-69A7-vH | 8371 | 11132 | 14395 | 14701 | 15007 |
| CD70 | CD70-10B4-vH | 8372 | 11133 | 14396 | 14702 | 15008 |
| CD70 | CD70-24D-vH | 8373 | 11134 | 14397 | 14703 | 15009 |
| CD70 | CD70-25D-vH | 8374 | 11135 | 14398 | 14704 | 15010 |
| HIV1-env glycoprotein | HIV1-N49P6-vH | 8375 | 11136 | 14399 | 14705 | 15011 |
| HIV1-env glycoprotein | HIV1-N49P7-vH | 8376 | 11137 | 14400 | 14706 | 15012 |
| HIV1-env glycoprotein | HIV1-N49P11-vH | 8377 | 11138 | 14401 | 14707 | 15013 |
| HIV1-env glycoprotein | HIV1-N60P1-1-vH | 8378 | 11139 | 14402 | 14708 | 15014 |
| HIV1-env glycoprotein | HIV1-N60P25-vH | 8379 | 11140 | 14403 | 14709 | 15015 |
| HIV1-env glycoprotein | HIV1-N49P9-vH | 8380 | 11141 | 14404 | 14710 | 15016 |
| HIV1-env glycoprotein | HIV1-N60P2-1-vH | 8381 | 11142 | 14405 | 14711 | 15017 |
| HIV1-env glycoprotein | HIV1-N60P31-1-vH | 8382 | 11143 | 14406 | 14712 | 15018 |
| HIV1-env glycoprotein | HIV1-N60P22-vH | 8383 | 11144 | 14407 | 14713 | 15019 |
| HIV1-env glycoprotein | HIV1-N60P38-vH | 8384 | 11145 | 14408 | 14714 | 15020 |
| HIV1-env glycoprotein | HIV1-N60P30-vH | 8385 | 11146 | 14409 | 14715 | 15021 |
| HIV1-env glycoprotein | HIV1-N60P36-vH | 8386 | 11147 | 14410 | 14716 | 15022 |
| HIV1-env glycoprotein | HIV1-N60P39-vH | 8387 | 11148 | 14411 | 14717 | 15023 |
| HIV1-env glycoprotein | HIV1-N6039-1-vH | 8388 | 11149 | 14412 | 14718 | 15024 |
| HIV1-env glycoprotein | HIV1-N60P47-vH | 8389 | 11150 | 14413 | 14719 | 15025 |
| HIV1-env glycoprotein | HIV1-N60P48-vH | 8390 | 11151 | 14414 | 14720 | 15026 |

TABLE 6B-continued

| TARGET | NAME of vH | SEQ ID vH (DNA) | SEQ ID vH (PRT) | SEQ ID-vH CDR1 | SEQ ID-vH CDR2 | SEQ ID-vH CDR3 |
|---|---|---|---|---|---|---|
| HIV1-env glycoprotein | HIV1-N60P51-vH | 8391 | 11152 | 14415 | 14721 | 15027 |
| HIV1-env glycoprotein | HIV1-N60P35-vH | 8392 | 11153 | 14416 | 14722 | 15028 |
| HIV1-env glycoprotein | HIV1-N60P37-vH | 8393 | 11154 | 14417 | 14723 | 15029 |
| Lym1 | hu-Lym1-vH | 8394 | 11155 | 14418 | 14724 | 15030 |
| Lym2 | hu-Lym2-vH | 8395 | 11156 | 14419 | 14725 | 15031 |
| BCMA | BCMA-USC1-vH | 8396 | 11157 | 14420 | 14726 | 15032 |
| BCMA | BCMA-USC2-vH | 8397 | 11158 | 14421 | 14727 | 15033 |
| BCMA | BCMA-USC3-vH | 8398 | 11159 | 14422 | 14728 | 15034 |
| BCMA | BCMA-USC4-vH | 8399 | 11160 | 14423 | 14729 | 15035 |
| BCMA | BCMA-USC5-vH | 8400 | 11161 | 14424 | 14730 | 15036 |
| BCMA | BCMA-USC6-vH | 8401 | 11162 | 14425 | 14731 | 15037 |
| BCMA | BCMA-USC7-vH | 8402 | 11163 | 14426 | 14732 | 15038 |
| CD43 | CD43-huJL-1-257-10-vH | 8403 | 11164 | 14427 | 14733 | 15039 |

TABLE 6C scFV Fragments

| Target | NAME | SEQ ID-DNA | SEQ ID-PRT | Target | NAME | SEQ ID-DNA | SEQ ID-PRT |
|---|---|---|---|---|---|---|---|
| CD19 | FMC63 | 8404 | 11165 | CDH17 | CDH17-PTA001A4 | 8443 | 11204 |
| CD19 | huFMC63-11 | 8405 | 11166 | CDH19 | CDH19-16A4 | 8444 | 11205 |
| CD19 | CD19Bu12 | 8406 | 11167 | EGFR | Cetuximab | 8445 | 11206 |
| CD19 | CD19MM | 8407 | 11168 | CLEC5A | CLEC5A-8H8F5 | 8446 | 11207 |
| CD19 | CD19-4G7 | 8408 | 11169 | CLEC5A | CLEC5A-3E12A2 | 8447 | 11208 |
| HIV1-env | HIV1-N6 | 8409 | 11170 | CLL1 | CLL1-M26 | 8448 | 11209 |
| ALK | Alk-48 | 8410 | 11171 | CLL1 | CLL1-M32 | 8449 | 11210 |
| ALK | Alk-58 | 8411 | 11172 | CMVpp65 | CMVpp65-F5 | 8450 | 11211 |
| Amyloid | Amyloid-158 | 8412 | 11173 | CS1 | CS1-huLuc63 | 8451 | 11212 |
| CD45 | BC8-CD45 | 8413 | 11174 | CS1 | CS1-HuLuc64 | 8452 | 11213 |
| BCMA | BCMA-J6M0 | 8414 | 11175 | CS1 | CS1-huLuc90 | 8453 | 11214 |
| BCMA | BCMA-huC12A3-L3H3 | 8415 | 11176 | CSF2RA | CSF2RA-Ab6 | 8454 | 11215 |
| BCMA | BCMA-ET-40 | 8416 | 11177 | CSF2RA | CSF2RA-Ab1 | 8455 | 11216 |
| BCMA | BCMA-ET-54 | 8417 | 11178 | DLL3 | DLL3-hSC16-13 | 8456 | 11217 |
| CCR4 | CCR4-humAb1567 | 8418 | 11179 | DLL3 | DLL3-hSC16-56 | 8457 | 11218 |
| CD5 | CD5-9 | 8419 | 11180 | EBNA3c | EBNA3c-315 | 8458 | 11219 |
| CD5 | CD5-18 | 8420 | 11181 | Ebv-gp350 | EBV-gp350 | 8459 | 11220 |
| CD20 | CD20-2F2 | 8421 | 11182 | EGFRviii | EGFRvIII-139 | 8460 | 11221 |
| CD20 | CD20-GA101 | 8422 | 11183 | EGFRviii | EGFRvIII-2173 | 8461 | 11222 |
| CD22 | CD22-h10F4v2 | 8423 | 11184 | EpCam1 | Epcam1-MM1 | 8462 | 11223 |
| CD22 | CD22-H22Rhov2 ACDRKA | 8424 | 11185 | EpCam1 | Epcam1-D5K5 | 8463 | 11224 |
| CD22 | CD22-m971 | 8425 | 11186 | FLT3 | FLT3-NC7 | 8464 | 11225 |
| CD30 | CD30- | 8426 | 11187 | FITC | FITC | 8465 | 11226 |

TABLE 6C-continued

| | | | | scFV Fragments | | | |

| Target | NAME | SEQ ID-DNA | SEQ ID-PRT | Target | NAME | SEQ ID-DNA | SEQ ID-PRT |
|---|---|---|---|---|---|---|---|
| | 5F11 | | | Influenza A HA | FLU-MEDI-8852 | 8466 | 11227 |
| CD30 | CD30-Ac10 | 8427 | 11188 | | | | |
| CD32 | CD32-Med9 | 8428 | 11189 | FR1 | FR1-huMov19 | 8467 | 11228 |
| CD33 | CD33-AF5 | 8429 | 11190 | GAD | GAD-G3H8 | 8468 | 11229 |
| CD33 | CD33-huMyc9 | 8430 | 11191 | GD2 | GD2-hu14-18 | 8469 | 11230 |
| CD34 | CD34-hu4C7 | 8431 | 11192 | GD2 | GD2-hu3F8 | 8470 | 11231 |
| CD44v6 | CD44v6-Biwa8 | 8432 | 11193 | GD3 | GD3-KM-641 | 8471 | 11232 |
| CD70 | CD70-h1F6 | 8433 | 11194 | GFRa4 | GFRAlpha4-P4-6 | 8472 | 11233 |
| CD79b | CD79b-2F2 | 8434 | 11195 | GFRa4 | GFRa4-P4-10 | 8473 | 11234 |
| CD123 | CD123-CSL362 | 8435 | 11196 | GM1 | GM1-5B2 | 8474 | 11235 |
| CD138 | CD138 | 8436 | 11197 | GM1 | GM1-7E5 | 8475 | 11236 |
| CD179b | CD179b | 8437 | 11198 | GPRC5D | GPRC5D-ET150-5 | 8476 | 11237 |
| CD276 | CD276-17 | 8438 | 11199 | GPRC5D | GPRC5D-ET150-18 | 8477 | 11238 |
| CD324 | CD324-SC10-6 | 8439 | 11200 | gp100 | gp100 | 8478 | 11239 |
| CD324 | CD324-hSC10-17 | 8440 | 11201 | gp100 | gp100-G2D12 | 8479 | 11240 |
| CDH6 | CDH6-NOV710 | 8441 | 11202 | GPC3 | GPC3-4E5 | 8480 | 11241 |
| CDH6 | CDH6-NOV712 | 8442 | 11203 | gpNMB | gpNMB-115 | 8481 | 11242 |
| GRP78 | GRP78-GC18 | 8482 | 11243 | PDL1 | PDL1-SP142 | 8522 | 11283 |
| HIV1-gag(77-85) | HIV1-E5 | 8483 | 11244 | PDL1 | PDL1-10A5 | 8523 | 11284 |
| HIV1-env | HIV1-3BNC117 | 8484 | 11245 | PSCA | PSCA-Ha14-121 | 8524 | 11285 |
| HIV1-env | HIV1-PGT-128 | 8485 | 11246 | PSCA | PSCA-Ha14-117 | 8525 | 11286 |
| HIV1-env | HIV1-VR-C01 | 8486 | 11247 | PR1 | PR1 | 8526 | 11287 |
| HIV1-env | HIV1-X5 | 8487 | 11248 | PSMA | PSMA-006 | 8527 | 11288 |
| HMW-MAA | HMW-MAA-hIND | 8488 | 11249 | PSMA | PSMA-J591 | 8528 | 11289 |
| HTLV1-TAX | HTLV-TAX-T3F2 | 8489 | 11250 | PTK7 | PTK7-hSC6-23 | 8529 | 11290 |
| HTLV1-TAX | HTLV-TAX-T3E3 | 8490 | 11251 | PTK7 | PTK7-SC6-10-2 | 8530 | 11291 |
| IL11Ra | IL11Ra-8E2-Ts107 | 8491 | 11252 | ROR1 | ROR1-4A5 | 8531 | 11292 |
| IL13Ra2 | IL13Ra2-hu107 | 8492 | 11253 | ROR1 | ROR1-4C10 | 8532 | 11293 |
| IL13Ra2 | IL13Ra2-Hul08 | 8493 | 11254 | Mesothelin | SD1-vHH-Linker-SD2-vHH | 8533 | 11294 |
| KSHV-K8.1 | KSHV-4C3 | 8494 | 11255 | SLea | SLea-7E3 | 8534 | 11295 |
| LAMP1 | LAMP1-humabl-2 | 8495 | 11256 | SLea | SLea-5B1 | 8535 | 11296 |
| LAMP1 | LAMP1-Mb4 | 8496 | 11257 | SSEA4 | SSEA4 | 8536 | 11297 |
| LewisY | LewisY-huS193 | 8497 | 11258 | TCRB1 | TCRB1-CP01-E09 | 8537 | 11298 |
| L1CAM | L1CAM-9-3-HU3 | 8498 | 11259 | TCRB1 | TCRB1-Jovi1 | 8538 | 11299 |
| Lym1 | Lym1 | 8499 | 11260 | TCRB2 | TCRB2-CP01-D05 | 8539 | 11300 |
| Lym2 | Lym2 | 8500 | 11261 | TCRB2 | TCRB2-CP01-E05 | 8540 | 11301 |
| CD79b | huMA79bv28 | 8501 | 11262 | TCRgd | TCRgd-G5-4 | 8541 | 11302 |

TABLE 6C-continued

| | | | | | | | |
|---|---|---|---|---|---|---|---|
| | | | | scFV Fragments | | | |

| Target | NAME | SEQ ID-DNA | SEQ ID-PRT | Target | NAME | SEQ ID-DNA | SEQ ID-PRT |
|---|---|---|---|---|---|---|---|
| MART1 | MART1-CAG10 | 8502 | 11263 | TERT | TERT-4A9-T540 | 8542 | 11303 |
| MART1 | MART1-CLA12 | 8503 | 11264 | TERT | TERT-3G3-T865 | 8543 | 11304 |
| Mesothelin | Mesothelin-m912 | 8504 | 11265 | TGFBR2 | TGFBR2-Ab1 | 8544 | 11305 |
| MPL | MPL-175 | 8505 | 11266 | TIM1 | TIM1-HVCR1-270-2 | 8545 | 11306 |
| MPL | MPL-161 | 8506 | 11267 | TIM1 | TIM1-HVCR1-ARD5 | 8546 | 11307 |
| MPL | MPL-161-HL | 8507 | 11268 | TnAg | TnAg | 8547 | 11308 |
| MPL | MPL-111 | 8508 | 11269 | Tn-Muc1 | TnMuc1-hu5E5-RHA8-RKA-2 | 8548 | 11309 |
| MPL | MPL-178 | 8509 | 11270 | TROP2 | TROP2-ARA47-HV3KV3 | 8549 | 11310 |
| MPL | MPL-AB317 | 8510 | 11271 | TROP2 | TROP2-h7E6-SVG | 8550 | 11311 |
| MPL | MPL-12E10 | 8511 | 11272 | TSHR | TSHR-K1-70 | 8551 | 11312 |
| MPL | MPL-huVB22Bw5 | 8512 | 11273 | TSHR | TSHR-KB1 | 8552 | 11313 |
| Muc1 | Muc1-D6-M3B8 | 8513 | 11274 | TSHR | TSHR-5C9 | 8553 | 11314 |
| Muc1 | MUC1-D6-M3A1 | 8514 | 11275 | TSLRP | TSLRP | 8554 | 11315 |
| Muc16 | Muc16-4H11 | 8515 | 11276 | Tyrosinase | Tyros-B2 | 8555 | 11316 |
| EGFR | Nimotuzumab | 8516 | 11277 | Tyrosinase | Tyros-MC1 | 8556 | 11317 |
| NKG2D | NKG2D-MS | 8517 | 11278 | Tyrosinase | Tyros-TA2 | 8557 | 11318 |
| NYBR1 | NYBR1 | 8518 | 11279 | VEGFR3 | VEGFR3-Ab1 | 8558 | 11319 |
| NY-ESO | NYESO-T1 | 8519 | 11280 | WT1 | WT1-Ab1 | 8559 | 11320 |
| NY-ESO | NYESO-T1 | 8520 | 11281 | WT1 | WT1-Ab5 | 8560 | 11321 |
| PDL1 | PDL1-Atezoli | 8521 | 11282 | WT1 | WT1-Ab13 | 8561 | 11322 |
| WT1 | WT1-Ab15 | 8562 | 11323 | CD22 | CD22-65 | 8658 | 11356 |
| CD123 | CD123-1172 | 8563 | 11324 | CD19 | hu-FMC65 | 8659 | 11357 |
| CDH19 | CDH19-4B10 | 8564 | 11325 | MPL | MPL-hu-175-2 | 8660 | 11358 |
| FRbeta | FRbeta-m923 | 8565 | 11326 | MPL | MPL-hu-111-2 | 8661 | 11359 |
| LHR-8B7 | LHR-8B7 | 8566 | 11327 | CD179a | CD179a-2460-B04 | 8662 | 11360 |
| LHR-5F4-21 | LHR-5F4-21 | 8567 | 11328 | CD179a | CD179a-2462-E07 | 8663 | 11361 |
| B7H4 | B7H4-hu22C10 | 8568 | 11329 | CD37 | CD37-TRU-HL | 8664 | 11362 |
| B7H4-hu1D11 | B7H4-hu1D11 | 8569 | 11330 | CD37 | huCD37-Boeh | 8665 | 11363 |
| IgE | IgE-omalizumab | 8570 | 11331 | CD70 | CD70-13D | 8666 | 11364 |
| CD23 | CD23-p5E8 | 8571 | 11332 | CD70 | CD70-16D | 8667 | 11365 |
| GCC | GCC-5F9 | 8572 | 11333 | CD70 | CD70-21D | 8668 | 11366 |
| GCC | GCC-Ab229 | 8573 | 11334 | CD70 | CD70-1G2D | 8669 | 11367 |
| CD200R | CD200R-huDx182 | 8637 | 11335 | CD70 | CD70-hu2H5 | 8670 | 11368 |
| Tn-Muc1-5E5 | Tn-Muc1-5E5 | 8638 | 11336 | CD70 | CD70-69A7 | 8671 | 11369 |
| Igk-Light Chain | Kappa-LC1 | 8639 | 11337 | CD70 | CD70-10B4 | 8672 | 11370 |
| PTK7 | PTK7-7C8 | 8640 | 11338 | CD70 | CD70-24D | 8673 | 11371 |

TABLE 6C-continued

| | | | | | | | |
|---|---|---|---|---|---|---|---|
| | | | | scFV Fragments | | | |

| Target | NAME | SEQ ID-DNA | SEQ ID-PRT | Target | NAME | SEQ ID-DNA | SEQ ID-PRT |
|---|---|---|---|---|---|---|---|
| PTK7 | PTK7-12C6a | 8641 | 11339 | CD70 | CD70-25D | 8674 | 11372 |
| CD19 | hCD19-EUK5-13 | 8642 | 11340 | HIV1-env | HIV1-N49P6 | 8675 | 11373 |
| Ras | Ras-Ab2 | 8643 | 11341 | HIV1-env | HIV1-N49P7 | 8676 | 11374 |
| Ras | Ras-Ab4 | 8644 | 11342 | HIV1-env | HIV1-N49P11 | 8677 | 11375 |
| CLD18A2 | CLD18A2-43A11 | 8645 | 11343 | HIV1-env | HIV1-N60P1-1 | 8678 | 11376 |
| CLD18A2 | CLD18A2-175D10 | 8646 | 11344 | HIV1-env | HIV1-N60P25 | 8679 | 11377 |
| CD43 | CD43-huJL-1-257-10 | 8647 | 11345 | HIV1-env | HIV1-N49P9 | 8680 | 11378 |
| CD69L | CD69L-DREG200 | 8648 | 11346 | HIV1-env | HIV1-N60P2-1 | 8681 | 11379 |
| NY-ESO | NYESO-35-15 | 8649 | 11347 | HIV1-env | HIV1-N60P31-1 | 8682 | 11380 |
| Pgp | Pgp-9F11 | 8650 | 11348 | HIV1-env | HIV1-N60P22 | 8683 | 11381 |
| Streptag | Streptag | 8651 | 11349 | HIV1-env | HIV1-N60P38 | 8684 | 11382 |
| MPL | Hu-161-2 | 8652 | 11350 | HIV1-env | HIV1-N60P30 | 8685 | 11383 |
| Pgp | Pgp-MRK16 | 8653 | 11351 | HIV1-env | HIV1-N60P36 | 8686 | 11384 |
| CD22 | CD22-5 | 8654 | 11352 | HIV1-env | HIV1-N60P39 | 8687 | 11385 |
| CD22 | CD22-10 | 8655 | 11353 | HIV1-env | HIV1-N6039.1 | 8688 | 11386 |
| CD22 | CD22-31 | 8656 | 11354 | HIV1-env | HIV1-N60P47 | 8689 | 11387 |
| CD22 | CD22-53 | 8657 | 11355 | HIV1-env | HIV1-N60P48 | 8690 | 11388 |
| HIV1-env | HIV1-N60P51 | 8691 | 11389 | BCMA | BCMA-USC3 | 8698 | 11396 |
| HIV1-env | HIV1-N60P35 | 8692 | 11390 | BCMA | BCMA-USC4 | 8699 | 11397 |
| HIV1-env | HIV1-N60P37 | 8693 | 11391 | BCMA | BCMA-USC5 | 8700 | 11398 |
| Lym1 | hu-Lym1 | 8694 | 11392 | BCMA | BCMA-USC6 | 8701 | 11399 |
| Lym2 | hu-Lym2 | 8695 | 11393 | BCMA | BCMA-USC7 | 8702 | 11400 |
| BCMA | BCMA-USC1 | 8696 | 11394 | CD33 | CD33-SGNh2H12 | 8727 | 15099 |
| BCMA | BCMA-USC2 | 8697 | 11395 | CD33 | CD33-15G15-33 | 8728 | 15100 |
| CD19 | CD19-MEDI-3649 | 8698 | 15070 | CD33 | CD33-33H4 | 8729 | 15101 |
| CD19 | CD19-Medrex-24D1 | 8699 | 15071 | CD33 | CD33-9C3-2 | 8730 | 15102 |
| CD19 | CD8SP-Ritx-CD19-MOR0028 | 8700 | 15072 | CD99 | CD99-hu12E7 | 8731 | 15103 |
| CD19 | CD19-HD37-H2L1 | 8701 | 15073 | CD123 | CD123-DART1-1 | 8732 | 15104 |
| CD19 | CD19-huBly3 | 8702 | 15074 | CD123 | CD123-DART1-2 | 8733 | 15105 |
| CD19 | CD19-huSJ25C1 | 8703 | 15075 | CD123 | CD123-I3RB18 | 8734 | 15106 |
| CD19 | CD8SP-Ritx-CD19-hB4 | 8704 | 15076 | CD123 | CD123-hu3E3 | 8735 | 15107 |
| CD19 | CD19-hu-mR005-1 | 8705 | 15077 | CD123 | CD123-9F6 | 8736 | 15108 |
| CD19 | CD19-hA19 | 8706 | 15078 | CD123 | CD123-I3RB2 | 8737 | 15109 |
| AFP/MHC | AFP-61 | 8707 | 15079 | CD123 | CD123- | 8738 | 15110 |

TABLE 6C-continued

| | | scFV Fragments | | | | | | |
|---|---|---|---|---|---|---|---|---|
| Target | NAME | SEQ ID- DNA | SEQ ID- PRT | Target | NAME | SEQ ID- DNA | SEQ ID- PRT | |
| I | | | | | 1176 | | | |
| AFP/MHC I | AFP-76 | 8708 | 15080 | CD123 | CD8SP- Ritx2- CD123- 8B11 | 8739 | 15111 | |
| AFP/MHC I | AFP-79 | 8709 | 15081 | CD123 | CD123- 2B8 | 8740 | 15112 | |
| BCMA | BCMA- ET-03 | 8710 | 15082 | CD123 | CD123- 9D7 | 8741 | 15113 | |
| BCMA | BCMA- huC11.D5.3L1H3 | 8711 | 15083 | CD123 | CD123- 3B10 | 8742 | 15114 | |
| BCMA | BCMA- huC13-F12 | 8712 | 15084 | CLL1 | CLL1- 21C9- L2H3 | 8743 | 15115 | |
| CD20 | CD20- 11B8 | 8713 | 15085 | CLL1 | CLL1- 6E7L4H1e | 8744 | 15116 | |
| CD20 | CD20-2C6 | 8714 | 15086 | CLL1 | CLL1- hu1075-v1 | 8745 | 15117 | |
| CD20 | CD20-2H7 | 8715 | 15087 | CLL1 | CLL1- hu1075-v2 | 8746 | 15118 | |
| CD20 | CD20- hA20 | 8716 | 15088 | CS1 | CS1- PDL241 | 8747 | 15119 | |
| CD20 | CD20-BM- CA-1925- v4 | 8717 | 15089 | CS1 | CS1- Hu27A | 8748 | 15120 | |
| CD20 | CD20- Ubli-v4 | 8718 | 15090 | CS1 | CS1- ScHu34C3 | 8749 | 15121 | |
| CD20 | CD20-2H7 | 8719 | 15091 | CS1 | CS1-Hu31- D2 | 8750 | 15122 | |
| CD20 | CD20- h1F5 | 8720 | 15092 | CS1 | CS1-Luc34 | 8751 | 15123 | |
| CD20 | CD20-7D8 | 8721 | 15093 | CS1 | CS1- LucX2 | 8752 | 15124 | |
| CD20 | CD20- 7D8-vL- linker-GA- Tag-VH | 8722 | 15094 | FITC | FITC-4M- 53 | 8753 | 15125 | |
| CD20 | CD20- AME-33 | 8723 | 15095 | FITC | FITC-E2- HL | 8754 | 15126 | |
| CD43 | CD43- huJL-1- 257-10 | 8703 | 11401 | GPRC5D | GPRC5D- ET150-1 | 8755 | 15127 | |
| CD22 | CD22- m971-HL | 8724 | 15096 | GPRC5D | GPRC5D- ET150-2 | 8756 | 15128 | |
| CD33 | CD8SP- Ritx2- BC33- Boehr2800308 | 8725 | 15097 | HLA-A2 | HLA-A2- 3PB2 | 8757 | 15129 | |
| CD33 | CD8SP- Ritx2- CD33- Him3-4 | 8726 | 15098 | HPV16/MHC I | HPV16-7-8 | 8758 | 15130 | |
| TF1 | TF1-98 | 8760 | 15132 | HPV16/MHC I | HPV16-2 | 8759 | 15131 | |

55

TABLE 6D

| | CAR COMPONENTS | | | | |
|---|---|---|---|---|---|
| CAR component | SEQ ID NO (DNA) | SEQ ID NO (PRT) | CAR component | SEQ ID NO (DNA) | SEQ ID NO (PRT) |
| F2A | 925 | 4838 | IgG1-CH1-TCRd-6MD | 962 | 4875 |
| T2A | 926 | 4839 | IgG1-CH1-TCRa-SDVP- | 963 | 4876 |

TABLE 6D-continued

CAR COMPONENTS

| CAR component | SEQ ID NO (DNA) | SEQ ID NO (PRT) | CAR component | SEQ ID NO (DNA) | SEQ ID NO (PRT) |
|---|---|---|---|---|---|
| | | | 6MD | | |
| P2A | 928 | 4841 | IgG1-CH1-TCRa-wt2-opt-6MD | 964 | 4877 |
| E2A | 930 | 4843 | hTCRa-WT | 3885 | 15041 |
| SGSG Linker | 931 | 4844 | hTCRa-CSDVP | 3886 | 15042 |
| FURINE SITE | 933 | 4846 | hTCRa-opt2 | 3887 | 15043 |
| hCD8-Hinge-TM | 936 | 4849 | hTCRa-T48C-opt | 3889 | 15045 |
| hCD8-Hinge-TM-BBz | 937 | 4850 | hTCRa-S61R | 3892 | 15048 |
| 4-1BB-cytosolic-domain | 939 | 4852 | hTCR-b1-constant | 3895 | 15051 |
| CD3z-cytosolic-domain | 940 | 4853 | hTCR-b2-constant | 3896 | 15052 |
| CD28-Hinge-TM-CP | 942 | 4855 | hTCRb-WT | 3897 | 15053 |
| CD3d-ECDTMCP-opt2 | 944 | 4857 | hTCRb-S57C-opt1 | 3898 | 15054 |
| CD3eECDTMCP-opt2 | 948 | 4861 | hTCRb-KACIAH | 3899 | 15055 |
| CD3g-ECDTMCP-opt2 | 949 | 4862 | hTCRb-opt2 | 3900 | 15056 |
| CD3zECDTMCP-opt2 | 958 | 4871 | hTCRb-R79G | 3910 | 15066 |
| IgCL-TCRg-6MD | 959 | 4872 | hTCRg-(hTCR-gamma) | 3912 | 15068 |
| IgCL-TCRb-IAH-6MD | 960 | 4873 | hTCR-(hTCR-delta) | 3913 | 15069 |
| IgCL-TCRb-wt2-opt-6MD | 961 | 4874 | CD8-Signal-Peptide | 1 | 3914 |
| IgH-Signal Peptide | 5 | 3918 | (GGGGS)x3_LINKER | 278 | 4191 |
| Myc-Tag | 903 | 4816 | V5 Tag | 908 | 4821 |
| RiTX2-TAG | 918 | 4831 | RITX4 TAG | 919 | 4832 |
| PG4SP | 288 | 4201 | EAAAK | 292 | 4205 |
| PG4SP-v2-U | 289 | 4202 | EAAAK-v2 | 293 | 4206 |
| E-coil | 290 | 4203 | K-coil | 291 | 4204 |
| TCRa-opt-6MD | 15141 | 15133 | TCRg-6MD | 15143 | 15135 |
| TCRb-opt-6MD | 15142 | 15134 | TCRd-6MD | 15144 | 15136 |

TABLE 7

EXEMPLARY ACCESSORY MODULES

| Accessory Module | SEQ ID NO (DNA) | SEQ ID NO (PRT) | Accessory Module | SEQ ID NO (DNA) | SEQ ID NO (PRT) |
|---|---|---|---|---|---|
| K13-opt | 7768 | 10538 | IKK1-S176E-S180E | 1004 | 4917 |
| K13-vFLIP | 972 | 4885 | FKBPx2-hNEMO-K277A | 1006 | 4919 |
| FKBP-K13 | 973 | 4886 | FKBPx2-hNEMO-L753(251) | 1007 | 4920 |
| FKBPX2-K13 | 974 | 4887 | FKBPx2-hNEMO-L600(200) | 1008 | 4921 |
| Myr-FKBPx2-K13 | 975 | 4888 | FKBPx2-RIP-ID | 1009 | 4922 |
| FKBPx2-HTLV2-Tax-RS | 976 | 4889 | hNEMO-FL-GS-FKBPv36X2 | 7763 | 10533 |
| FKBPx2-Flag-HTLV2-Tax-RS | 977 | 4890 | hNEMO-L825-GS-FKBPv36x2 | 7764 | 10534 |
| hNEMO-K277A | 979 | 4892 | hNEMO-L753-GS-FKBPv36x2 | 7765 | 10535 |
| hNEMO-D23V-K277A | 980 | 4893 | hNEMO-L600-GS-FKBPv36x2 | 7766 | 10536 |
| hNEMO-K277A-L1161 | 986 | 4899 | hNEMO-K277A-Delta-V249-K255 | 7767 | 10537 |
| hNEMO-K277A-L1014 | 989 | 4902 | IKK1-delta-SCD-FKBPv36x2 | 7781 | 10541 |
| mNEMO-K270A | 992 | 4905 | IKK2-delta-SCD-FKBPv36x2 | 7782 | 10542 |
| RIP-ID | 998 | 4911 | TCL-1A | 1005 | 4918 |
| MyD88 | 999 | 4912 | MTCP-1 | 7769 | 10539 |
| MYD88-L265P | 1000 | 4913 | CMV-141 | 7770 | 10540 |
| IKK2 | 1001 | 4914 | IgSP-[hTRAC-opt2] | 1010 | 4923 |
| IKK2-S177E-S181E | 1002 | 4915 | IgSP-[hTRBC-opt2] | 1011 | 4924 |
| IKK1 | 1003 | 4916 | | | |
| IgSP-TCRa-opt-6MD | 15145 | 15137 | IgSP-TCRg-6MD | 15147 | 15139 |
| IgSP-TCRb-opt-6MD | 15146 | 15138 | IgSP-TCRd-6MD | 15148 | 15140 |

TABLE 8

MHC I (HLA-A2) restricted peptides used for generation of CARs

| Protein/Epitope | SEQ ID NO: |
|---|---|
| gp100 | 10511 |
| gp100 | 10512 |
| gp100 | 10513 |
| MUC1-A7 (130-138) | 10514 |
| MUC1-D6 (13-21) | 10515 |
| TAX (11-19) | 10516 |
| hTERT(540-548) | 10517 |
| hTERT (865-873) | 10518 |
| HIV1 gag (77-85) | 10519 |
| CMV-pp65(495-503) | 10520 |
| MART (26-35) | 10521 |

TABLE 8-continued

MHC I (HLA-A2) restricted peptides used for generation of CARs

| Protein/Epitope | SEQ ID NO: |
|---|---|
| EBNA-3A (596-604) | 10522 |
| EBNA-3c | 10523 |
| WT1 | 10524 |
| PR1 | 10525 |
| Ras9-G12V | 10526 |
| HPV16-E7 | 10527 |
| NY-ESO-1-(155-163) | 10528 |
| NY-ESO-1-(157-165) | 10529 |
| NY-ESO-1-(157-167) | 10530 |

TABLE 9

| CAR/BiTE "X" TARGET | EXEMPLARY DISEASE TARGETED BY CARs (i.e. conventional CARs and next generation CARs. E.g., SIR, Ab-TCR, and TFP) and Bispecific T Cell Engagers (BiTE) |
|---|---|
| CD19 | ALL, CLL, lymphoma, lymphoid blast crisis of CML, multiple myeloma, immune disorders |
| ALK | Non Small Cell Lung Cancer (NSCLC), ALCL (anaplastic large cell lymphoma), IMT (inflammatory myofibroblastic tumor), or nemoblastoma |
| CD45 | Blood cancers |
| BCMA | Myeloma, PEL, plasma cell leukemia, Waldenstrom's macroglobinemia |
| CD5 | Blood cancer, T cell leukemia, T cell lymphoma |
| CD20 | Blood cancers, Leukemia, ALL, CLL, lymphoma, immune disorders |
| CD22 | Blood cancers, Leukemia, ALL, CLL, lymphoma, lymphoid blast crisis of CML, immune disorders |
| CD23 | Blood cancers, Leukemia, ALL, CLL, lymphoma, autoimmune disorders |
| CD30 | Hodgkins's lymphoma, Cutaneous T cell lymphoma |
| CD32 | Solid tumors |
| CD33 | Blood cancers, AML, MDS |
| CD34 | Blood cancers, AML, MDS |
| CD44v6 | Blood cancers, AML, MDS |
| CD70 | Blood cancers, lymphoma, myeloma, Waldenstrom's macroglobulinemia, Kidney cancer |
| CD79b | Blood cancers, ALL, Lymphoma |
| CD123 | Blood cancers, AML, MDS |
| CD138 | Blood cancers, Myeloma, PEL, plasma cell leukemia, waldenstrom's macroglobulinemia |
| CD179b | Blood cancers, ALL, Lymphoma |
| CD276/B7-H3 | Ewing's sarcoma, neuroblastoma, rhabdomyosarcoma, ovarian, colorectal and lung cancers |
| CD324 | Solid tumors, esophageal, prostate, colorectal, breast, lung cancers |
| CDH6 | Solid tumors, renal, ovarian, thyroid cancers |
| CDH17 | Adenocarciniomas, gastrointestinal, lung, ovarian, endometrial cancers |
| CDH19 | Solid tumor, Melanoma |
| EGFR | Colon cancer, lung cancer |
| CLEC5A | Blood cancers, Leukemia, AML |
| GR/LHR | Prostate cancer, ovarian cancer or breast cancer |
| CLL1 | Blood cancer, Leukemia |
| CMVpp65 | CMV infection, CMV colitis, CMV pneumonitis |
| CS1 | Blood cancers, myeloma, PEL, plasma cell leukemia |
| CSF2RA | AML, CML, MDS |
| CD123 | Blood cancers, AML, MDS |
| DLL3 | Melanoma, lung cancer or ovarian cancer |
| EBNA3c/MHC I | Epstein Barr virus infection and related diseases including cancers |
| EBV-gp350 | Epstein Barr virus infection and related diseases |
| EGFR | Solid tumors, Colon cancer, lung cancer |
| EGFRvIII | Solid tumors, glioblastoma |
| EpCam1 | Gastrointestinal cancer |
| FLT3 | Blood cancers, AML, MDS, ALL |
| Folate Receptor alpha(FR1 or FOLR1) | Ovarian cancer, NSCLC, endometrial cancer, renal cancer, or other solid tumors |
| FSHR | Prostate cancer, ovarian cancer or breast cancer |
| GD2 | Neuroblastoma |
| GD3 | Melanoma |
| GFRa4 | Cancer, thyroid medullary cancer |
| Fucosyl-GM1(GM1) | Small cell lung cancer |
| GPRC5D | Myeloma, PEL, plasma cell leukemia, waldenstrom's macroglobulinemia |
| gp100 | Melanoma |
| GPC3 | Solid tumors, Lung cancer |

TABLE 9-continued

| CAR/BiTE "X" TARGET | EXEMPLARY DISEASE TARGETED BY CARs (i.e. conventional CARs and next generation CARs. E.g., SIR, Ab-TCR, and TFP) and Bispecific T Cell Engagers (BiTE) |
|---|---|
| gpNMB | Melanoma, brain tumors, gastric cancers |
| GRP78 | Myeloma |
| Her2 | Solid tumors, breast cancer, stomach cancer |
| Her3 | Colorectal, breast cancer |
| HMW-MAA | Melanoma |
| HTLV1-TAX/MHC I | HTLV1 infection associated diseases, Adult T cell leukemia-lymphoma |
| IL11Ra | Blood cancers, AML, ALL, CML, MDS, sarcomas |
| IL6Ra | Solid tumors, Liver cancer |
| IL13Ra2 | Glioblastomas |
| KSHV-K8.1 | Kaposi's sarcoma, PEL, Multicentric Castleman's disease |
| LAMP1 | Blood cancers, AML, ALL, MDS, CLL, CML |
| LewisY | Cancers |
| L1CAM | Solid tumors, ovarian, breast, endometrial cancers, melanoma |
| LHR | Prostate cancer, ovarian cancer or breast cancer |
| Lym1 | Blood cancer, Leukemia, Lymphoma |
| Lym2 | Blood cancer, Leukemia, Lymphoma |
| CD79b | Blood cancers, lymphoma |
| MART1/MHC I | Melanoma |
| Mesothelin | Mesothelioma, ovarian cancer, pancreatic cancer |
| Muc1/MHC I | Breast cancer, gastric cancer, colorectal cancer, lung cancer, or other solid tumors |
| Muc16 | Ovarian cancer |
| NKG2D | Leukemia, lymphoma or myeloma |
| NYBR1 | Breast cancer |
| PSCA | Prostate cancer |
| PR1/MHC I | Blood cancer, Leukemia |
| Prolactin Receptor | Breast cancer, chromophobe renal cell cancer |
| PSMA | Prostate cancer |
| PTK7 | Melanoma, lung cancer or ovarian cancer |
| ROR1 | Blood cancer, B cell malignancy, lymphoma, CLL |
| SLea | Pancreatic cancer, colon cancer |
| SSEA4 | Pancreatic cancer |
| Tyrosinase/MHC I | Melanoma |
| TCRB1 | T cell leukemias and lymphomas, autoimmune disorders |
| TCRB2 | T cell leukemias and lymphomas, autoimmune disorders |
| TCRgd | T cell leukemias and lymphomas, autoimmune disorders |
| hTERT | Solid tumors, blood cancers |
| TGFBR2 | Solid tumors, keloid |
| TIM1/HAVCR1 | Kidney cancer, liver cancer |
| TROP2 | Solid tumors, Breast cancer, prostate cancer |
| TSHR | Thyroid cancer, T cell leukemia, T cell Lymphoma |
| TSLPR | Blood cancers, Leukemias, AML, MDS |
| Tyrosinase/MHC I | Melanoma |
| VEGFR3 | Solid tumors |
| WT1/MHC I | Blood cancers, AML |
| Folate Receptorβ | AML, Myeloma |
| B7H4 | Breast cancer or ovarian cancer |
| CD23 | Blood cancers, Leukemias, CLL |
| GCC | Gastrointestinal cancer |
| CD200R | Blood cancers, AML, MDS |
| AFP/MHC I | Solid tumors, Liver cancer |
| CD99 | Liver cancer |
| GPRC5D | Myeloma, waldenstrom's macroglobinemia |
| HPV16-E7/MHC I | HPV16 associated cancers, cervical cancer, head and neck cancers |
| Tissue Factor 1 (TF1) | Solid tumors |
| Tn-Muc1 | Solid tumors and blood cancers |
| Igk-Light Chain | Myeloma, plasma cell leukemia |
| Ras G12V/MHC I | Solid tumors and blood cancers |
| CLD18A2 (Claudin 18.2) | Gastric, pancreatic, esophageal, ovarian, or lung cancer |
| CD43 | Blood cancers, AML |
| NY-ESO-1/MHC I | Myeloma |
| MPL/TPO-R | Blood cancer, AML, MDS, CML, ALL |
| P-glycoprotein (MDR1) | Renal cancer, liver cancer, Myeloma |
| CD179a | Blood cancers, Acute Leukemia, CLL, ALL, Lymphoma |
| STEAP1 | Gastric or prostate cancer, or lymphoma |
| Liv1 (SLC39A6) | Breast or prostate cancer |

TABLE 9-continued

| CAR/BiTE "X" TARGET | EXEMPLARY DISEASE TARGETED BY CARs (i.e. conventional CARs and next generation CARs. E.g., SIR, Ab-TCR, and TFP) and Bispecific T Cell Engagers (BiTE) |
|---|---|
| Nectin4 (PVRL4) | Bladder, renal, cervical, lung, head and neck or breast cancer |
| Cripto (TDGF1) | Colorectal or endometrial or ovarian cancer |
| gpA33 | Colorectal or endometrial or ovarian cancer |
| FLT3 | Blood cancers, AML, ALL, MDS |
| BST1/CD157 | Blood cancers, AML, MDS |
| IL1RAP | Liver, colorectal, cervical, lung or ovarian cancer |
| Chloride channel | Glioma |
| IgE | Allergy |
| HLA-A2 | Graft vs host disease, tissue rejection (SIR Expressed in regulatory T cells) |
| Amyloid | Amyloidoses, alzheimer's disease |
| HIV1-env | HIVI/AIDS and related conditions |
| HIV1-gag | HIV1/AIDS and related conditions |
| Influenza A HA | Influenza A infection |

TABLE 10

Exemplary CARs Targeting HIV-1 Envelop Glycoprotein
Based on HIV1-N49P6 vL and vH binding domains

| CAR TYPE | Accessory Module | CAR NAME | SEQ ID NO (DNA) | SEQ ID NO (PRT) |
|---|---|---|---|---|
| 2nd Gen CAR | None | CD8SP-HIV1-N49P6-vL-Gly-Ser-Linker-HIV1-N49P6-vH-Myc-CD8TM-BBz | 8704 | 11402 |
| 2nd Gen CAR | None | CD8SP-HIV1-N49P6-vH-Gly-Ser-Linker-vL-Myc-CD8TM-BBz | 8705 | 11403 |
| 1st Gen CAR | vFLIP-K13 | CD8SP-HIV1-N49P6-vL-Gly-Ser-Linker-HIV1-N49P6-vH-Myc-CD8TM-z-P2A-K13 | 8706 | 11404 |
| 1st Gen CAR | hNEMO-K277A | CD8SP-HIV1-N49P6-(vL-vH)-Myc-z-P2A-hNEMO-K277A | 8707 | 11405 |
| TFP | hNEMO-K277A | CD8SP-HIV1-N49P6-(vL-vH)-CD3e-ECDTMCP-opt2-P2A-hNEMO-K277A | 8708 | 11406 |
| TFP | hNEMO-K277A | CD8SP-HIV1-N49P6-(vL-vH)-CD3d-ECDTMCP-opt2-P2A-hNEMO-K277A | 8709 | 11407 |
| TFP | hNEMO-K277A | CD8SP-HIV1-N49P6-(vL-vH)-CD3g-ECDTMCP-opt2-P2A-hNEMO-K277A | 8710 | 11408 |
| TFP | hNEMO-K277A | CD8SP-HIV1-N49P6-(vL-vH)-CD3z-ECDTMCP-opt2-P2A-hNEMO-K277A | 8711 | 11409 |
| TFP | hNEMO-K277A | CD8SP-HIV1-N49P6-(vH-vL)-CD3e-ECDTMCP-opt2-P2A-hNEMO-K277A | 8712 | 11410 |
| TFP | hNEMO-K277A | CD8SP-HIV1-N49P6-(vH-vL)-CD3d-ECDTMCP-opt2-P2A-hNEMO-K277A | 8713 | 11411 |
| TFP | hNEMO-K277A | CD8SP-HIV1-N49P6-(vH-vL)-CD3g-ECDTMCP-opt2-P2A-hNEMO-K277A | 8714 | 11412 |
| TFP | hNEMO-K277A | CD8SP-HIV1-N49P6-(vH-vL)-CD3z-ECDTMCP-opt2-P2A-hNEMO-K277A | 8715 | 11413 |
| DC SIR | None | CD8SP-HIV1-N49P6-vL-[hTCRb-KACIAH]-F-P2A-SP-HIV1-N49P6-vH-[hTCRa-CSDVP] | 8716 | 11414 |
| DC SIR | None | CD8SP-HIV1-N49P6-vL-[hTCRa-CSDVP]-F-F2A-SP-HIV1-N49P6-vH-[hTCRb-KACIAH] | 8717 | 11415 |
| DC SIR | None | CD8SP-HIV1-N49P6-vL-PG4SP-v2-[hTCRb-KACIAH]-F-P2A-SP-HIV1-N49P6-vH-PG4SP-[hTCRa-CSDVP] | 8718 | 11416 |
| DC SIR | None | CD8SP-HIV1-N49P6-vL-E-Coil-[hTCRb-KACIAH]-F-P2A-SP-HIV1-N49P6-vH-K-Coil-[hTCRa-CSDVP] | 8719 | 11417 |
| DC SIR | None | CD8SP-HIV1-N49P6-vL-EAAAK-[hTCRb-KACIAH]-F-P2A-SP-HIV1-N49P6-vH-EAAAK-v2-[hTCRa-CSDVP] | 8720 | 11418 |
| DC SIR | None | CD8SP-HIV1-N49P6-vL-V5-[hTCRb-KACIAH]-F-P2A-SP-HIV1-N49P6-vH-Myc4-[hTCRa-CSDVP] | 8721 | 11419 |
| DC SIR | hNEMO-K277A | CD8SP-HIV1-N49P6-vL-[hTCRb-KACIAH]-F-P2A-SP-HIV1-N49P6-vH-[hTCRa-CSDVP]-F-F2A-hNEMO-K277A | 8722 | 11420 |
| DC SIR | hNEMO-K277A | CD8SP-HIV1-N49P6-vL-[hTCRa- | 8723 | 11421 |

TABLE 10-continued

Exemplary CARs Targeting HIV-1 Envelop Glycoprotein
Based on HIV1-N49P6 vL and vH binding domains

| CAR TYPE | Accessory Module | CAR NAME | SEQ ID NO (DNA) | SEQ ID NO (PRT) |
|---|---|---|---|---|
| | | CSDVP]-F-F2A-SP-HIV1-N49P6-vH-[hTCRb-KACIAH]-F-P2A-hNEMO-K277A | | |
| Ab-TCR | hNEMO-K277A | CD8SP-HIV1-N49P6-vL-[IgCL-TCRg-6MD]-F-P2A-SP-HIV1-N49P6-vH-[IgG1-CH1-TCRd-6MD]-F-F2A-hNEMO-K277A | 8724 | 11422 |
| Ab-TCR | hNEMO-K277A | CD8SP-HIV1-N49P6-vL-[IgCL-TCRb-IAH-6MD]-F-P2A-SP-HIV1-N49P6-vH-[IgG1-CH1-TCRa-SDVP-6MD]-F-F2A-hNEMO-K277A | 8725 | 11423 |
| Ab-TCR | hNEMO-K277A | CD8SP-HIV1-N49P6-vL-[IgCL-TCRb-wt2-opt-6MD]-F-P2A-SP-HIV1-N49P6-vH-[IgG1-CH1-TCRa-wt2-opt-6MD]-F-F2A-hNEMO-K277A | 8726 | 11424 |
| 1st Gen CAR | hNEMO-K277A-Delta-V249-K255 | CD8SP-HIV1-N49P6-vL-Gly-Ser-Linker-HIV1-N49P6-vH--CD8TM-z-P2A-hNEMO-K277A-Delta-V249-K255 | 8727 | 11425 |
| 1st Gen CAR | IKK2-S177E-S181E | CD8SP-HIV1-N49P6-vL-Gly-Ser-Linker-HIV1-N49P6-vH--CD8TM-z-P2A-IKK2-S177E-S181E | 8728 | 11426 |
| DC SIR | hNEMO-K277A | CD8SP-HIV1-N49P6-vL-[hTCRa-T48C]-F-F2A-SP-HIV1-N49P6-vH-[hTCRb-S57C]-F-P2A-hNEMO-K277A | 8729 | 11427 |
| DC SIR | IKK1-S176E-S180E | CD8SP-HIV1-N49P6-vL-[hTCRb-S57C]-F-P2A-SP-HIV1-N49P6-vH-[hTCRa-T48C]-F-F2A-IKK1-S176E-S180E | 8730 | 11428 |
| DC SIR | hNEMO-K277A-Delta-V249-K255 | CD8SP-HIV1-N49P6-vL-[hTCRb-S57C]-F-P2A-SP-HIV1-N49P6-vH-[hTCRa-T48C]-F-F2A-hNEMO-K277A-Delta-V249-K255 | 8731 | 11429 |
| OHC SIR | None | CD8SP-MYC-[hTCRa-T48C-opt1]-F-F2A-SP-HIV1-N49P6-vL-Gly-Ser-Linker-HIV1-N49P6-vH-V5-[hTCRb-S57C-opt1] | 8732 | 11430 |
| DC SIR | None | CD8SP-HIV1-N49P6-vL-V5-[hTCRb-S57C-opt]-F-P2A-SP-HIV1-N49P6-vH-Myc-[hTCRa-T48C-opt] | 8733 | 11431 |
| DC SIR | None | CD8SP-HIV1-N49P6-vL-[hTCRb-opt2]-F-P2A-SP-HIV1-N49P6-vH-[hTCRa-opt2] | 8734 | 11432 |
| DC SIR | None | CD8SP-HIV1-N49P6-vL-[hTCRb-opt2]-F-P2A-SP-HIV1-N49P6-vH-Myc-[preTCRa-Del48] | 8735 | 11433 |
| OHC SIR | None | CD8SP-[hTCRb-opt2]-F-P2A-CD8SP-HIV1-N49P6-vL-Gly-Ser-Linker-HIV1-N49P6-vH-Myc4-[preTCRa-Del48] | 8736 | 11434 |
| DC SIR | None | CD8SP-HIV1-N49P6-vL-V5-[hTCRg1-opt]-F-P2A-SP-HIV1-N49P6-vH-Myc-[hTCRd-opt] | 8737 | 11435 |

Abbreviations; 1$^{st}$ Gen CAR, First Generation CAR; 2$^{nd}$ Gen CAR, 2$^{nd}$ Generation CAR; DC SIR, Double Chain SIR; OHC SIR, One half chain SIR.

The accessory modules in the above exemplary constructs in Table 10 are optional and can be deleted or replaced by other accessory modules.

TABLE 11

SEQ ID NOs OF CARs CONTAINING DIFFERENT ANTIGEN BINDING DOMAINS
USING SEQ ID NOs OF CARS WITH HIV1-N49P6 AS REFERENCE

| Target Antigen | Antigen binding domain | CAR SEQ ID NOs (DNA) | CAR SEQ ID NO (PRT) |
|---|---|---|---|
| HIV1 Env | HIV1-N49P6 | 8704-8737 | 11402-11435 |
| HIV1 Env | HIV1-N49P7 | 8738-8771 | 11436-11469 |
| HIV1 Env | HIV1-N49P11 | 8806-8839 | 11504-11537 |

TABLE 11-continued

SEQ ID NOs OF CARs CONTAINING DIFFERENT ANTIGEN BINDING DOMAINS
USING SEQ ID NOs OF CARS WITH HIV1-N49P6 AS REFERENCE

| Target Antigen | Antigen binding domain | CAR SEQ ID NOs (DNA) | CAR SEQ ID NO (PRT) |
|---|---|---|---|
| HIV1 Env | HIV1-N60P1-1 | 8840-8873 | 11538-11571 |
| HIV1 Env | HIV1-N60P25 | 8942-8975 | 11640-11673 |
| HIV1 Env | HIV1-N49P9 | 8772-8805 | 11470-11503 |
| HIV1 Env | HIV1-N60P2-1 | 8874-8907 | 11572-11605 |
| HIV1 Env | HIV1-N60P31-1 | 9010-9043 | 11708-11741 |
| HIV1 Env | HIV1-N60P22 | 8908-8941 | 11606-11639 |
| HIV1 Env | HIV1-N60P38 | 9146-9179 | 11844-11877 |
| HIV1 Env | HIV1-N60P30 | 8976-9009 | 11674-11707 |
| HIV1 Env | HIV1-N60P36 | 9078-9111 | 11776-11809 |
| HIV1 Env | HIV1-N60P39 | 9180-9213 | 11878-11911 |
| HIV1 Env | HIV1-N6039-1 | 9316-9349 | 12014-12047 |
| HIV1 Env | HIV1-N60P47 | 9214-9247 | 11912-11945 |
| HIV1 Env | HIV1-N60P48 | 9248-9281 | 11946-11979 |
| HIV1 Env | HIV1-N60P51 | 9282-9315 | 11980-12013 |
| HIV1 Env | HIV1-N60P35 | 9044-9077 | 11742-11775 |
| HIV1 Env | HIV1-N60P37 | 9112-9145 | 11810-11843 |
| Lym1 | hu-Lym1 | 10370-10403 | 13068-13101 |
| Lym2 | hu-Lym2 | 10404-10437 | 13102-13135 |
| BCMA | BCMA-USC1 | 9418-9451 | 12116-12149 |
| BCMA | BCMA-USC2 | 9452-9485 | 12150-12183 |
| BCMA | BCMA-USC3 | 9486-9519 | 12184-12217 |
| BCMA | BCMA-USC4 | 9520-9554 | 12218-12252 |
| BCMA | BCMA-USC5 | 9555-9587 | 12253-12285 |
| BCMA | BCMA-USC6 | 9588-9621 | 12286-12319 |
| BCMA | BCMA-USC7 | 9622-9655 | 12320-12353 |
| CD43 | CD43-huJL-1-257-10 | 9758-9791 | 12456-12489 |
| BCMA | BCMA-huC11.D5.3L1H3 | 9350-9383 | 12048-12081 |
| BCMA | BCMA-huC13-F12 | 9384-9417 | 12082-12115 |
| CD20 | CD20-Ubli-v4 | 9656-9689 | 12354-12387 |
| CD37 | CD37-TRU-HL | 9724-9757 | 12422-12455 |
| CD70 | CD70-1G2D | 9792-9825 | 12490-12523 |
| CD70 | CD70-10B4 | 9826-9859 | 12524-12557 |
| CD70 | CD70-13D | 9860-9893 | 12558-12591 |
| CD70 | CD70-16D | 9894-9927 | 12592-12625 |
| CD70 | CD70-21D | 9928-9961 | 12626-12659 |
| CD70 | CD70-24D | 9962-9995 | 12660-12693 |
| CD70 | CD70-25D | 9996-10029 | 12694-12727 |
| CD70 | CD70-69A7 | 10030-10063 | 12728-12761 |
| CD70 | CD70-hu-2H5 | 10064-10097 | 12762-12795 |
| CD123 | CD123-DART-1 | 10098-10131 | 12796-12829 |
| CD123 | CD123-DART-2 | 10132-10165 | 12830-12863 |
| CD179a | CD179a-2460-B04 | 10166-10199 | 12864-12897 |
| CD179a | CD179a-2462-E07 | 10200-10233 | 12898-12931 |
| FITC | FITC-4M-53 | 10234-10267 | 12932-12965 |
| FITC | FITC-E2 | 10268-10301 | 12966-12999 |
| MPL | Hu-161-2 | 10302-10335 | 13000-13033 |
| CD37 | huCD37-Boeh | 10336-10369 | 13034-13067 |
| Kappa-Light Chain | Kappa-LC1 | 10438-10471 | 13136-13169 |
| MPL | MPL-hu-111-2 | 10472-10505 | 13170-13203 |

TABLE 12

Exemplary Ist Generation CAR constructs coexpressing hNEMO-K277A
and PAC accessory modules. Both accessory modules are optional.

| Target | Name of CAR constructs including the name of antigen binding domain | SEQ ID NO (DNA) | SEQ ID NO (PRT) |
|---|---|---|---|
| CD19 | CD8SP-FMC63-(vL-vH)-Myc-z-P2A-hNEMO-K277A-Flag-T2A-PAC | 1594 | 5507 |
| CD19 | CD8SP-huFMC63-11-(vL-vH)-Myc-z-P2A-hNEMO-K277A-Flag-T2A-PAC | 1595 | 5508 |
| CD19 | CD8SP-huFMC63-11-N203Q-(vL-vH)-Myc-z-P2A-hNEMO-K277A-Flag-T2A-PAC | 1596 | 5509 |
| CD19 | CD8SP-CD19Bul2-(vL-vH)-Myc-z-P2A-hNEMO-K277A-Flag-T2A-PAC | 1597 | 5510 |
| CD19 | CD8SP-2-CD19MM-(vL-vH)-Myc-z-P2A-hNEMO-K277A-Flag-T2A-PAC | 1598 | 5511 |
| CD19 | CD8SP-CD19-4G7-(vL-vH)-Myc-z-P2A-hNEMO- | 1599 | 5512 |

TABLE 12-continued

Exemplary Ist Generation CAR constructs coexpressing hNEMO-K277A
and PAC accessory modules. Both accessory modules are optional.

| Target | Name of CAR constructs including the name of antigen binding domain | SEQ ID NO (DNA) | SEQ ID NO (PRT) |
|---|---|---|---|
| | K277A-Flag-T2A-PAC | | |
| CD19 | CD8SP-CD19-MEDI-3649-(vL-vH)-Myc-z-P2A-hNEMO-K277A-Flag-T2A-PAC | 1600 | 5513 |
| CD19 | CD8SP-CD19-Medrex-24D1-(vL-vH)-Myc-z-P2A-hNEMO-K277A-Flag-T2A-PAC | 1601 | 5514 |
| CD19 | CD8SP-Ritx-CD19-MOR0028-(vL-vH)-Myc-z-P2A-hNEMO-K277A-Flag-T2A-PAC | 1602 | 5515 |
| CD19 | CD8SP-CD19-HD37-H2L1-(vL-vH)-Myc-z-P2A-hNEMO-K277A-Flag-T2A-PAC | 1603 | 5516 |
| CD19 | CD8SP-CD19-huBly3-(vL-vH)-Myc-z-P2A-hNEMO-K277A-Flag-T2A-PAC | 1604 | 5517 |
| CD19 | CD8SP-CD19-huSJ25C1-(vL-vH)-Myc-z-P2A-hNEMO-K277A-Flag-T2A-PAC | 1605 | 5518 |
| CD19 | CD8SP-Ritx-CD19-hB4-(vL-vH)-Myc-z-P2A-hNEMO-K277A-Flag-T2A-PAC | 1606 | 5519 |
| CD19 | CD8SP-CD19-hu-mROO5-1-(vL-vH)-Myc-z-P2A-hNEMO-K277A-Flag-T2A-PAC | 1607 | 5520 |
| CD19 | CD8SP-CD19-hA19-(vL-vH)-Myc-z-P2A-hNEMO-K277A-Flag-T2A-PAC | 1608 | 5521 |
| AFP/MHC class I complex | CD8SP-AFP-61-(vL-vH)-Myc-z-P2A-hNEMO-K277A-Flag-T2A-PAC | 1609 | 5522 |
| AFP/MHC class I complex | CD8SP-AFP-76-(vL-vH)-Myc-z-P2A-hNEMO-K277A-Flag-T2A-PAC | 1610 | 5523 |
| AFP/MHC class I complex | CD8SP-AFP-79-(vL-vH)-Myc-z-P2A-hNEMO-K277A-Flag-T2A-PAC | 1611 | 5524 |
| HIV1-envelop glycoprotein | CD8SP-HIV1-N6-(vL-vH)-Myc-z-P2A-hNEMO-K277A-Flag-T2A-PAC | 1612 | 5525 |
| ALK | CD8SP-Alk-48-(vL-vH)-Myc-z-P2A-hNEMO-K277A-Flag-T2A-PAC | 1613 | 5526 |
| ALK | CD8SP-Alk-58-(vL-vH)-Myc-z-P2A-hNEMO-K277A-Flag-T2A-PAC | 1614 | 5527 |
| Amyloid | SP-Amyloid-158-(vL-vH)-Myc-z-P2A-hNEMO-K277A-Flag-T2A-PAC | 1615 | 5528 |
| Biotin | CD8SP-dc-Avidin-Myc-z-P2A-hNEMO-K277A-Flag-T2A-PAC | 1616 | 5529 |
| CD45 | CD8SP-BC8-CD45-(vL-vH)-Myc-z-P2A-hNEMO-K277A-Flag-T2A-PAC | 1617 | 5530 |
| BCMA | CD8SP-BCMA-J6M0-(vL-vH)-Myc-z-P2A-hNEMO-K277A-Flag-T2A-PAC | 1618 | 5531 |
| BCMA | CD8SP-BCMA-huC12A3-L3H3-(vL-vH)-Myc-z-P2A-hNEMO-K277A-Flag-T2A-PAC | 1619 | 5532 |
| BCMA | CD8SP-BCMA-ET-40-(vL-vH)-Myc-z-P2A-hNEMO-K277A-Flag-T2A-PAC | 1620 | 5533 |
| BCMA | CD8SP-BCMA-ET-54-(vL-vH)-Myc-z-P2A-hNEMO-K277A-Flag-T2A-PAC | 1621 | 5534 |
| BCMA | CD8SP-BCMA-ET-03-(vL-vH)-Myc-z-P2A-hNEMO-K277A-Flag-T2A-PAC | 1622 | 5535 |
| BCMA | CD8SP-BCMA-huC11.D5.3L1H3-(vL-vH)-Myc-z-P2A-hNEMO-K277A-Flag-T2A-PAC | 1623 | 5536 |
| BCMA | CD8SP-BCMA-huC13-F12-(vL-vH)-Myc-z-P2A-hNEMO-K277A-Flag-T2A-PAC | 1624 | 5537 |
| CCR4 | CD8SP-CCR4-humAbl567-(vL-vH)-Myc-z-P2A-hNEMO-K277A-Flag-T2A-PAC | 1625 | 5538 |
| HIV1-envelop glycoprotein | CD8SP-CD4-ECD-Linker-DC-SIGN-Myc-z-P2A-hNEMO-K277A-Flag-T2A-PAC | 1626 | 5539 |
| CD5 | CD8SP-CD5-9-(vL-vH)-Myc-z-P2A-hNEMO-K277A-Flag-T2A-PAC | 1627 | 5540 |
| CD5 | CD8SP-CD5-18-(vL-vH)-Myc-z-P2A-hNEMO-K277A-Flag-T2A-PAC | 1628 | 5541 |
| Ig Fc | CD8SP-CD16A-V158-ECD-v2-Myc-z-P2A-hNEMO-K277A-Flag-T2A-PAC | 1629 | 5542 |
| Ig Fc | CD8SP-CD16A-V158-ECD-v1-Myc-z-P2A-hNEMO-K277A-Flag-T2A-PAC | 1630 | 5543 |
| CD20 | CD8SP-CD20-2F2-(vL-vH)-Myc-z-P2A-hNEMO-K277A-Flag-T2A-PAC | 1631 | 5544 |
| CD20 | CD8SP-CD20-GA101-(vL-vH)-Myc-z-P2A-hNEMO-K277A-Flag-T2A-PAC | 1632 | 5545 |
| CD20 | CD8SP-CD20-Leu16-(vL-vH)-Myc-z-P2A-hNEMO-K277A-Flag-T2A-PAC | 1633 | 5546 |
| CD20 | CD8SP-CD20-11B8-(vL-vH)-Myc-z-P2A-hNEMO-K277A-Flag-T2A-PAC | 1634 | 5547 |
| CD20 | CD8SP-CD20-2C6-(vL-vH)-Myc-z-P2A-hNEMO-K277A-Flag-T2A-PAC | 1635 | 5548 |

TABLE 12-continued

Exemplary Ist Generation CAR constructs coexpressing hNEMO-K277A
and PAC accessory modules. Both accessory modules are optional.

| Target | Name of CAR constructs including the name of antigen binding domain | SEQ ID NO (DNA) | SEQ ID NO (PRT) |
|---|---|---|---|
| CD20 | CD8SP-CD20-2H7-(vL-vH)-Myc-z-P2A-hNEMO-K277A-Flag-T2A-PAC | 1636 | 5549 |
| CD20 | CD8SP-CD20-hA20-(vL-vH)-Myc-z-P2A-hNEMO-K277A-Flag-T2A-PAC | 1637 | 5550 |
| CD20 | CD8SP-CD20-BM-CA-1925-v4-(vL-vH)-Myc-z-P2A-hNEMO-K277A-Flag-T2A-PAC | 1638 | 5551 |
| CD20 | CD8SP-CD20-Ubli-v4-(vL-vH)-Myc-z-P2A-hNEMO-K277A-Flag-T2A-PAC | 1639 | 5552 |
| CD20 | CD8SP-CD20-2H7-(vL-vH)-Myc-z-P2A-hNEMO-K277A-Flag-T2A-PAC | 1640 | 5553 |
| CD20 | CD8SP-CD20-hlF5-(vL-vH)-Myc-z-P2A-hNEMO-K277A-Flag-T2A-PAC | 1641 | 5554 |
| CD20 | CD8SP-CD20-7D8-(vL-vH)-Myc-z-P2A-hNEMO-K277A-Flag-T2A-PAC | 1642 | 5555 |
| CD20 | CD8SP-CD20-AME-33-(vL-vH)-Myc-z-P2A-hNEMO-K277A-Flag-T2A-PAC | 1643 | 5556 |
| CD22 | CD8SP-CD22-h10F4v2-(vL-vH)-Myc-z-P2A-hNEMO-K277A-Flag-T2A-PAC | 1644 | 5557 |
| CD22 | CD8SP-CD22-H22Rhov2ACDRKA-(vL-vH)-Myc-z-P2A-hNEMO-K277A-Flag-T2A-PAC | 1645 | 5558 |
| CD22 | CD8SP-CD22-m971-(vL-vH)-Myc-z-P2A-hNEMO-K277A-Flag-T2A-PAC | 1646 | 5559 |
| CD22 | CD8SP-CD22-m971-HL-(vH-vL)-Myc-z-P2A-hNEMO-K277A-Flag-T2A-PAC | 1647 | 5560 |
| CD30 | CD8SP-CD30-5F11-(vL-vH)-Myc-z-P2A-hNEMO-K277A-Flag-T2A-PAC | 1648 | 5561 |
| CD30 | CD8SP-CD30-Ac10-(vL-vH)-Myc-z-P2A-hNEMO-K277A-Flag-T2A-PAC | 1649 | 5562 |
| CD32 | CD8SP-CD32-Med9-(vL-vH)-Myc-z-P2A-hNEMO-K277A-Flag-T2A-PAC | 1650 | 5563 |
| CD33 | CD8SP-CD33-AF5-(vL-vH)-Myc-z-P2A-hNEMO-K277A-Flag-T2A-PAC | 1651 | 5564 |
| CD33 | CD8SP-CD33-huMyc9-(vL-vH)-Myc-z-P2A-hNEMO-K277A-Flag-T2A-PAC | 1652 | 5565 |
| CD33 | CD8SP-CD33-Boehr2800308-(vL-vH)-Myc-z-P2A-hNEMO-K277A-Flag-T2A-PAC | 1653 | 5566 |
| CD33 | CD8SP-CD33-Him3-4-(vL-vH)-Myc-z-P2A-hNEMO-K277A-Flag-T2A-PAC | 1654 | 5567 |
| CD33 | CD8SP-CD33-SGNh2H12-(vL-vH)-Myc-z-P2A-hNEMO-K277A-Flag-T2A-PAC | 1655 | 5568 |
| CD33 | CD8SP-CD33-15G15-33-(vL-vH)-Myc-z-P2A-hNEMO-K277A-Flag-T2A-PAC | 1656 | 5569 |
| CD33 | CD8SP-CD33-33H4-(vL-vH)-Myc-z-P2A-hNEMO-K277A-Flag-T2A-PAC | 1657 | 5570 |
| CD33 | CD8SP-CD33-9C3-2-(vL-vH)-Myc-z-P2A-hNEMO-K277A-Flag-T2A-PAC | 1658 | 5571 |
| CD34 | CD8SP-CD34-hu4C7-(vL-vH)-Myc-z-P2A-hNEMO-K277A-Flag-T2A-PAC | 1659 | 5572 |
| CD44v6 | CD8SP-CD44v6-Biwa8-(vL-vH)-Myc-z-P2A-hNEMO-K277A-Flag-T2A-PAC | 1660 | 5573 |
| CD70 | CD8SP-CD70-h1F6-(vL-vH)-Myc-z-P2A-hNEMO-K277A-Flag-T2A-PAC | 1661 | 5574 |
| CD79b | CD8SP-CD79b-2F2-(vL-vH)-Myc-z-P2A-hNEMO-K277A-Flag-T2A-PAC | 1662 | 5575 |
| CD79b | CD8SP-huMA79bv28-(vL-vH)-Myc-z-P2A-hNEMO-K277A-Flag-T2A-PAC | 1663 | 5576 |
| CD99 | CD8SP-CD99-hu12E7-(vL-vH)-Myc-z-P2A-hNEMO-K277A-Flag-T2A-PAC | 1664 | 5577 |
| CD123 | CD8SP-CD123-CSL362-(vL-vH)-Myc-z-P2A-hNEMO-K277A-Flag-T2A-PAC | 1665 | 5578 |
| CD123 | CD8SP-CD123-1172-(vL-vH)-Myc-z-P2A-hNEMO-K277A-Flag-T2A-PAC | 1666 | 5579 |
| CD123 | CD8SP-CD123-DART-1-(vL-vH)-Myc-z-P2A-hNEMO-K277A-Flag-T2A-PAC | 1667 | 5580 |
| CD123 | CD8SP-CD123-DART-2-(vL-vH)-Myc-z-P2A-hNEMO-K277A-Flag-T2A-PAC | 1668 | 5581 |
| CD123 | CD8SP-CD123-I3RB18-(vL-vH)-Myc-z-P2A-hNEMO-K277A-Flag-T2A-PAC | 1669 | 5582 |
| CD123 | CD8SP-CD123-hu3E3-(vL-vH)-Myc-z-P2A-hNEMO-K277A-Flag-T2A-PAC | 1670 | 5583 |
| CD123 | CD8SP-CD123-9F6-(vL-vH)-Myc-z-P2A-hNEMO-K277A-Flag-T2A-PAC | 1671 | 5584 |
| CD123 | CD8SP-CD123-I3RB2-(vL-vH)-Myc-z-P2A- | 1672 | 5585 |

TABLE 12-continued

Exemplary Ist Generation CAR constructs coexpressing hNEMO-K277A
and PAC accessory modules. Both accessory modules are optional.

| Target | Name of CAR constructs including the name of antigen binding domain | SEQ ID NO (DNA) | SEQ ID NO (PRT) |
|---|---|---|---|
| | hNEMO-K277A-Flag-T2A-PAC | | |
| CD123 | CD8SP-CD123-1176-(vL-vH)-Myc-z-P2A-hNEMO-K277A-Flag-T2A-PAC | 1673 | 5586 |
| CD123 | CD8SP-Ritx2-CD123-8B11-(vL-vH)-Myc-z-P2A-hNEMO-K277A-Flag-T2A-PAC | 1674 | 5587 |
| CD123 | CD8SP-CD123-2B8-(vL-vH)-Myc-z-P2A-hNEMO-K277A-Flag-T2A-PAC | 1675 | 5588 |
| CD123 | CD8SP-CD123-9D7-(vL-vH)-Myc-z-P2A-hNEMO-K277A-Flag-T2A-PAC | 1676 | 5589 |
| CD123 | CD8SP-CD123-3B10-(vL-vH)-Myc-z-P2A-hNEMO-K277A-Flag-T2A-PAC | 1677 | 5590 |
| CD138 | CD8SP-CD138-(vL-vH)-Myc-z-P2A-hNEMO-K277A-Flag-T2A-PAC | 1678 | 5591 |
| CD179b | CD8SP-CD179b-(vL-vH)-Myc-z-P2A-hNEMO-K277A-Flag-T2A-PAC | 1679 | 5592 |
| CD276 | CD8SP-CD276-17-(vL-vH)-Myc-z-P2A-hNEMO-K277A-Flag-T2A-PAC | 1680 | 5593 |
| CD324 | CD8SP-CD324-SC10-6-(vL-vH)-Myc-z-P2A-hNEMO-K277A-Flag-T2A-PAC | 1681 | 5594 |
| CD324 | CD8SP-CD324-hSC10-17-(vL-vH)-Myc-z-P2A-hNEMO-K277A-Flag-T2A-PAC | 1682 | 5595 |
| CDH6 | CD8SP-CDH6-NOV710-(vL-vH)-Myc-z-P2A-hNEMO-K277A-Flag-T2A-PAC | 1683 | 5596 |
| CDH6 | CD8SP-CDH6-NOV712-(vL-vH)-Myc-z-P2A-hNEMO-K277A-Flag-T2A-PAC | 1684 | 5597 |
| CDH17 | CD8SP-CDH17-PTA001A4-(vL-vH)-Myc-z-P2A-hNEMO-K277A-Flag-T2A-PAC | 1685 | 5598 |
| CDH19 | CD8SP-CDH19-16A4-(vL-vH)-Myc-z-P2A-hNEMO-K277A-Flag-T2A-PAC | 1686 | 5599 |
| EGFR | CD8SP-Cetuximab-(vL-vH)-Myc-z-P2A-hNEMO-K277A-Flag-T2A-PAC | 1687 | 5600 |
| CLEC5A | CD8SP-CLEC5A-8H8F5-(vL-vH)-Myc-z-P2A-hNEMO-K277A-Flag-T2A-PAC | 1688 | 5601 |
| CLEC5A | CD8SP-CLEC5A-3E12A2-(vL-vH)-Myc-z-P2A-hNEMO-K277A-Flag-T2A-PAC | 1689 | 5602 |
| GR/LHR (Gonadotropin Receptor) | SP-CGHb-Linker-CGHa-Myc-z-P2A-hNEMO-K277A-Flag-T2A-PAC | 1690 | 5603 |
| CLL1 | CD8SP-CLL1-M26-(vL-vH)-Myc-z-P2A-hNEMO-K277A-Flag-T2A-PAC | 1691 | 5604 |
| CLL1 | CD8SP-CLL1-M32-(vL-vH)-Myc-z-P2A-hNEMO-K277A-Flag-T2A-PAC | 1692 | 5605 |
| CLL1 | CD8SP-CLL1-21C9-L2H3-(vL-vH)-Myc-z-P2A-hNEMO-K277A-Flag-T2A-PAC | 1693 | 5606 |
| CLL1 | CD8SP-CLL1-6E7L4H1e-(vL-vH)-Myc-z-P2A-hNEMO-K277A-Flag-T2A-PAC | 1694 | 5607 |
| CLL1 | CD8SP-CLL1-hu1075-v1-(vL-vH)-Myc-z-P2A-hNEMO-K277A-Flag-T2A-PAC | 1695 | 5608 |
| CLL1 | CD8SP-CLL1-hu1075-v2-(vL-vH)-Myc-z-P2A-hNEMO-K277A-Flag-T2A-PAC | 1696 | 5609 |
| CMVpp65/MHC class I complex | CD8SP-CMVpp65-F5-(vL-vH)-Myc-z-P2A-hNEMO-K277A-Flag-T2A-PAC | 1697 | 5610 |
| CS1 (SLAMF7) | CD8SP-CS1-huLuc63-(vL-vH)-Myc-z-P2A-hNEMO-K277A-Flag-T2A-PAC | 1698 | 5611 |
| CS1 (SLAMF7) | CD8SP-CS1-HuLuc64-(vL-vH)-Myc-z-P2A-hNEMO-K277A-Flag-T2A-PAC | 1699 | 5612 |
| CS1 (SLAMF7) | CD8SP-CS1-huLuc90-(vL-vH)-Myc-z-P2A-hNEMO-K277A-Flag-T2A-PAC | 1700 | 5613 |
| CS1 (SLAMF7) | CD8SP-CS1-PDL241-(vL-vH)-Myc-z-P2A-hNEMO-K277A-Flag-T2A-PAC | 1701 | 5614 |
| CS1 (SLAMF7) | CD8SP-CS1-Hu27A-(vL-vH)-Myc-z-P2A-hNEMO-K277A-Flag-T2A-PAC | 1702 | 5615 |
| CS1 (SLAMF7) | CD8SP-CS1-ScHu34C3-(vL-vH)-Myc-z-P2A-hNEMO-K277A-Flag-T2A-PAC | 1703 | 5616 |
| CS1 (SLAMF7) | CD8SP-CS1-Hu31-D2-(vL-vH)-Myc-z-P2A-hNEMO-K277A-Flag-T2A-PAC | 1704 | 5617 |
| CS1(SLAMF7) | CD8SP-CS1-Luc34-(vL-vH)-Myc-z-P2A-hNEMO-K277A-Flag-T2A-PAC | 1705 | 5618 |
| CS1 (SLAMF7) | CD8SP-CS1-LucX2-(vL-vH)-Myc-z-P2A-hNEMO-K277A-Flag-T2A-PAC | 1706 | 5619 |
| CSF2RA | CD8SP-CSF2RA-Ab6-(vL-vH)-Myc-z-P2A-hNEMO-K277A-Flag-T2A-PAC | 1707 | 5620 |
| CSF2RA | CD8SP-CSF2RA-Ab1-(vL-vH)-Myc-z-P2A- | 1708 | 5621 |

TABLE 12-continued

Exemplary Ist Generation CAR constructs coexpressing hNEMO-K277A
and PAC accessory modules. Both accessory modules are optional.

| Target | Name of CAR constructs including the name of antigen binding domain | SEQ ID NO (DNA) | SEQ ID NO (PRT) |
|---|---|---|---|
| | hNEMO-K277A-Flag-T2A-PAC | | |
| CXCR4 and CD123 | CD8SP-CXCR4-1-vHH-Linker-CD123-1-vHH-Myc-z-P2A-hNEMO-K277A-Flag-T2A-PAC | 1709 | 5622 |
| CXCR4 and CD123 | CD8SP-CXCR4-2-VHH-Linker-CD123-2-VHH-Myc-z-P2A-hNEMO-K277A-Flag-T2A-PAC | 1710 | 5623 |
| DLL3 (Delta Like Ligand 3) | CD8SP-DLL3-hSC16-13-(vL-vH)-Myc-z-P2A-hNEMO-K277A-Flag-T2A-PAC | 1711 | 5624 |
| DLL3 | CD8SP-DLL3-hSC16-56-(vL-vH)-Myc-z-P2A-hNEMO-K277A-Flag-T2A-PAC | 1712 | 5625 |
| EBNA3c/MHC class I complex | CD8SP-EBNA3c-315-(vL-vH)-Myc-z-P2A-hNEMO-K277A-Flag-T2A-PAC | 1713 | 5626 |
| EBV-gp350 | CD8SP-EBV-gp350-(vL-vH)-Myc-z-P2A-hNEMO-K277A-Flag-T2A-PAC | 1714 | 5627 |
| EGFR | CD8SP-EGFR1-vHH-Myc-z-P2A-hNEMO-K277A-Flag-T2A-PAC | 1715 | 5628 |
| EGFR & CEA | CD8SP-EGFR1-vHH-Linker-CEA1-vHH-Myc-z-P2A-hNEMO-K277A-Flag-T2A-PAC | 1716 | 5629 |
| EGFR & CEA | CD8SP-EGFR33-vHH-Linker-CEA5-vHH-Myc-z-P2A-hNEMO-K277A-Flag-T2A-PAC | 1717 | 5630 |
| EGFRvIII | CD8SP-EGFRvIII-139-(vL-vH)-Myc-z-P2A-hNEMO-K277A-Flag-T2A-PAC | 1718 | 5631 |
| EGFRvIII | CD8SP-EGFRvIII-2173-(vL-vH)-Myc-z-P2A-hNEMO-K277A-Flag-T2A-PAC | 1719 | 5632 |
| EpCam1 | CD8SP-Epcam1-MM1-(vL-vH)-Myc-z-P2A-hNEMO-K277A-Flag-T2A-PAC | 1720 | 5633 |
| EpCam1 | CD8SP-Epcam1-D5K5-(vL-vH)-Myc-z-P2A-hNEMO-K277A-Flag-T2A-PAC | 1721 | 5634 |
| FLT3 | CD8SP-FLT3-NC7-(vL-vH)-Myc-z-P2A-hNEMO-K277A-Flag-T2A-PAC | 1722 | 5635 |
| FITC | CD8SP-FITC-(vL-vH)-Myc-z-P2A-hNEMO-K277A-Flag-T2A-PAC | 1723 | 5636 |
| FITC | CD8SP-FITC-4M-53-(vL-vH)-Myc-z-P2A-hNEMO-K277A-Flag-T2A-PAC | 1724 | 5637 |
| FITC | CD8SP-FITC-E2-HL-(vH-vL)-Myc-z-P2A-hNEMO-K277A-Flag-T2A-PAC | 1725 | 5638 |
| Influenza A HA | CD8SP-FLU-MEDI-8852-(vL-vH)-Myc-z-P2A-hNEMO-K277A-Flag-T2A-PAC | 1726 | 5639 |
| FR1 (Folate Receptor alpha) | CD8SP-FR1-huMov19-(vL-vH)-Myc-z-P2A-hNEMO-K277A-Flag-T2A-PAC | 1727 | 5640 |
| FSHR (Follicle Stimulating Hormone Receptor) | CD8SP-FSHb-Linker-CGHa-Myc-z-P2A-hNEMO-K277A-Flag-T2A-PAC | 1728 | 5641 |
| GAD (Glutamic Acid Decarboxylase)/ MHC class I complex | CD8SP-GAD-G3H8-(vL-vH)-Myc-z-P2A-hNEMO-K277A-Flag-T2A-PAC | 1729 | 5642 |
| GD2 | CD8SP-GD2-hu14-18-(vL-vH)-Myc-z-P2A-hNEMO-K277A-Flag-T2A-PAC | 1730 | 5643 |
| GD2 | CD8SP-GD2-hu3F8-(vL-vH)-Myc-z-P2A-hNEMO-K277A-Flag-T2A-PAC | 1731 | 5644 |
| GD3 | CD8SP-GD3-KM-641-(vL-vH)-Myc-z-P2A-hNEMO-K277A-Flag-T2A-PAC | 1732 | 5645 |
| GFRa4 (GDNF Family Receptor Alpha 4) | CD8SP-GFRAlpha4-P4-6-(vL-vH)-Myc-z-P2A-hNEMO-K277A-Flag-T2A-PAC | 1733 | 5646 |
| GFRa4 | CD8SP-GFRa4-P4-10-(vL-vH)-Myc-z-P2A-hNEMO-K277A-Flag-T2A-PAC | 1734 | 5647 |
| GM1 | CD8SP-GM1-5B2-(vL-vH)-Myc-z-P2A-hNEMO-K277A-Flag-T2A-PAC | 1735 | 5648 |
| GM1 | CD8SP-GM1-7E5-(vL-vH)-Myc-z-P2A-hNEMO-K277A-Flag-T2A-PAC | 1736 | 5649 |
| GPRC5D (G-protein coupled receptor family C group 5 member D) | CD8SP-GPRC5D-ET150-5-(vL-vH)-Myc-z-P2A-hNEMO-K277A-Flag-T2A-PAC | 1737 | 5650 |
| GPRC5D | CD8SP-GPRC5D-ET150-18-(vL-vH)-Myc-z-P2A-hNEMO-K277A-Flag-T2A-PAC | 1738 | 5651 |
| GPRC5D | CD8SP-GPRC5D-ET150-1-(vL-vH)-Myc-z-P2A-hNEMO-K277A-Flag-T2A-PAC | 1739 | 5652 |
| GPRC5D | CD8SP-GPRC5D-ET150-2-(vL-vH)-Myc-z-P2A-hNEMO-K277A-Flag-T2A-PAC | 1740 | 5653 |
| gp100/MHC class I complex | CD8SP-gp100-(vL-vH)-Myc-z-P2A-hNEMO-K277A-Flag-T2A-PAC | 1741 | 5654 |

TABLE 12-continued

Exemplary Ist Generation CAR constructs coexpressing hNEMO-K277A
and PAC accessory modules. Both accessory modules are optional.

| Target | Name of CAR constructs including the name of antigen binding domain | SEQ ID NO (DNA) | SEQ ID NO (PRT) |
|---|---|---|---|
| gp100/MHC class I complex | CD8SP-gp100-G2D12-(vL-vH)-Myc-z-P2A-hNEMO-K277A-Flag-T2A-PAC | 1742 | 5655 |
| GPC3 (Glypican 3) | CD8SP-GPC3-4E5-(vL-vH)-Myc-z-P2A-hNEMO-K277A-Flag-T2A-PAC | 1743 | 5656 |
| gpNMB (Glycoprotein Nmb) | CD8SP-gpNMB-115-(vL-vH)-Myc-z-P2A-hNEMO-K277A-Flag-T2A-PAC | 1744 | 5657 |
| GRP78 | CD8SP-GRP78-GC18-(vL-vH)-Myc-z-P2A-hNEMO-K277A-Flag-T2A-PAC | 1745 | 5658 |
| Her2 | CD8SP-Her2-5F7-vHH-Myc-z-P2A-hNEMO-K277A-Flag-T2A-PAC | 1746 | 5659 |
| Her2 | IgHSP-Her2-Affi-Myc-z-P2A-hNEMO-K277A-Flag-T2A-PAC | 1747 | 5660 |
| Her2 | CD8SP-Her2-1-Darpin-Myc-z-P2A-hNEMO-K277A-Flag-T2A-PAC | 1748 | 5661 |
| Her2 | IgHSP-Her2-2-Darpin-Myc-z-P2A-hNEMO-K277A-Flag-T2A-PAC | 1749 | 5662 |
| Her2 | CD8SP-Her2-5F7-vHH-Linker-Her2-47D5-vHH-Myc-z-P2A-hNEMO-K277A-Flag-T2A-PAC | 1750 | 5663 |
| Her2 | CD8SP-Her2-Hu4D5-(vL-vH)-Myc-z-P2A-hNEMO-K277A-Flag-T2A-PAC | 1751 | 5664 |
| Her3 | CD8SP-Her3-17B05So-vHH-Myc-z-P2A-hNEMO-K277A-Flag-T2A-PAC | 1752 | 5665 |
| Her3 | CD8SP-Her3-Affi-Myc-z-P2A-hNEMO-K277A-Flag-T2A-PAC | 1753 | 5666 |
| Her2 and Her3 | CD8SP-Her3-17B05So-vHH-Linker-Her2-2D3-vHH-Myc-z-P2A-hNEMO-K277A-Flag-T2A-PAC | 1754 | 5667 |
| HIV1-gag/MHC class I complex | CD8SP-HIV1-E5-(vL-vH)-Myc-z-P2A-hNEMO-K277A-Flag-T2A-PAC | 1755 | 5668 |
| HIV1-envelop glycoprotein | CD8SP-HIV1-3BNC117-(vL-vH)-Myc-z-P2A-hNEMO-K277A-Flag-T2A-PAC | 1756 | 5669 |
| HIV1-envelop glycoprotein | CD8SP-HIV1-PGT-128-(vL-vH)-Myc-z-P2A-hNEMO-K277A-Flag-T2A-PAC | 1757 | 5670 |
| HIV1-envelop glycoprotein | CD8SP-HIV1-VR-C01-(vL-vH)-Myc-z-P2A-hNEMO-K277A-Flag-T2A-PAC | 1758 | 5671 |
| HIV1-envelop glycoprotein | CD8SP-HIV1-X5-(vL-vH)-Myc-z-P2A-hNEMO-K277A-Flag-T2A-PAC | 1759 | 5672 |
| HLA-A2 | CD8SP-HLA-A2-3PB2-(vL-vH)-Myc-z-P2A-hNEMO-K277A-Flag-T2A-PAC | 1760 | 5673 |
| HMW-MAA | CD8SP-HMW-MAA-hIND-(vL-vH)-Myc-z-P2A-hNEMO-K277A-Flag-T2A-PAC | 1761 | 5674 |
| HPV16-E7/MHC class I complex | CD8SP-HPV16-7-8-(vL-vH)-Myc-z-P2A-hNEMO-K277A-Flag-T2A-PAC | 1762 | 5675 |
| HPV16-E7/MHC class I complex | CD8SP-HPV16-2-(vL-vH)-Myc-z-P2A-hNEMO-K277A-Flag-T2A-PAC | 1763 | 5676 |
| HTLV1-TAX/MHC class I complex | CD8SP-HTLV-TAX-T3F2-(vL-vH)-Myc-z-P2A-hNEMO-K277A-Flag-T2A-PAC | 1764 | 5677 |
| HTLV1-TAX/MHC class I complex | CD8SP-HTLV-TAX-T3E3-(vL-vH)-Myc-z-P2A-hNEMO-K277A-Flag-T2A-PAC | 1765 | 5678 |
| IL11Ra | CD8SP-IL11Ra-8E2-Ts107-(vL-vH)-Myc-z-P2A-hNEMO-K277A-Flag-T2A-PAC | 1766 | 5679 |
| IL6Ra | IgHSP-IL6R-304-vHH-Myc-z-P2A-hNEMO-K277A-Flag-T2A-PAC | 1767 | 5680 |
| IL13Ra2 | CD8SP-IL13Ra2-hu107-(vL-vH)-Myc-z-P2A-hNEMO-K277A-Flag-T2A-PAC | 1768 | 5681 |
| IL13Ra2 | CD8SP-IL13Ra2-Hu108-(vL-vH)-Myc-z-P2A-hNEMO-K277A-Flag-T2A-PAC | 1769 | 5682 |
| KSHV-K8.1 | CD8SP-KSHV-4C3-(vL-vH)-Myc-z-P2A-hNEMO-K277A-Flag-T2A-PAC | 1770 | 5683 |
| LAMP1 (Lysosomal-associated membrane protein 1) | CD8SP-LAMP1-humab1-2-(vL-vH)-Myc-z-P2A-hNEMO-K277A-Flag-T2A-PAC | 1771 | 5684 |
| LAMP1 | CD8SP-LAMP1-Mb4-(vL-vH)-Myc-z-P2A-hNEMO-K277A-Flag-T2A-PAC | 1772 | 5685 |
| LewisY | CD8SP-LewisY-huS193-(vL-vH)-Myc-z-P2A-hNEMO-K277A-Flag-T2A-PAC | 1773 | 5686 |
| L1CAM | CD8SP-L1CAM-9-3-HU3-(vL-vH)-Myc-z-P2A-hNEMO-K277A-Flag-T2A-PAC | 1774 | 5687 |
| LHR | SP-LHb-Linker-CGHa-Myc-z-P2A-hNEMO- | 1775 | 5688 |

TABLE 12-continued

Exemplary Ist Generation CAR constructs coexpressing hNEMO-K277A
and PAC accessory modules. Both accessory modules are optional.

| Target | Name of CAR constructs including the name of antigen binding domain | SEQ ID NO (DNA) | SEQ ID NO (PRT) |
|---|---|---|---|
| | K277A-Flag-T2A-PAC | | |
| Lym1 | CD8SP-Lym1-(vL-vH)-Myc-z-P2A-hNEMO-K277A-Flag-T2A-PAC | 1776 | 5689 |
| Lym2 | CD8SP-Lym2-(vL-vH)-Myc-z-P2A-hNEMO-K277A-Flag-T2A-PAC | 1777 | 5690 |
| CD79b | CD8SP-huMA79bv28-(vL-vH)-Myc-z-P2A-hNEMO-K277A-Flag-T2A-PAC | 1778 | 5691 |
| MART1/MHC class I complex | CD8SP-MART1-CAG10-(vL-vH)-Myc-z-P2A-hNEMO-K277A-Flag-T2A-PAC | 1779 | 5692 |
| MART1/MHC class I complex | CD8SP-MART1-CLA12-(vL-vH)-Myc-z-P2A-hNEMO-K277A-Flag-T2A-PAC | 1780 | 5693 |
| Mesothelin | CD8SP-Mesothelin-m912-(vL-vH)-Myc-z-P2A-hNEMO-K277A-Flag-T2A-PAC | 1781 | 5694 |
| cMet | CD8SP-cMet-171-vHH-Myc-z-P2A-hNEMO-K277A-Flag-T2A-PAC | 1782 | 5695 |
| cMet and Her3 | CD8SP-cMET-171-vHH-Linker-Her3-21F06-vHH-Myc-z-P2A-hNEMO-K277A-Flag-T2A-PAC | 1783 | 5696 |
| MPL | CD8SP-MPL-175-(vL-vH)-Myc-z-P2A-hNEMO-K277A-Flag-T2A-PAC | 1784 | 5697 |
| MPL | CD8SP-MPL-161-(vL-vH)-Myc-z-P2A-hNEMO-K277A-Flag-T2A-PAC | 1785 | 5698 |
| MPL | CD8SP-MPL-161-HL-(vH-vL)-Myc-z-P2A-hNEMO-K277A-Flag-T2A-PAC | 1786 | 5699 |
| MPL | CD8SP-2-MPL-111-(vL-vH)-Myc-z-P2A-hNEMO-K277A-Flag-T2A-PAC | 1787 | 5700 |
| MPL | CD8SP-MPL-178-(vL-vH)-Myc-z-P2A-hNEMO-K277A-Flag-T2A-PAC | 1788 | 5701 |
| MPL | CD8SP-MPL-AB317-(vL-vH)-Myc-z-P2A-hNEMO-K277A-Flag-T2A-PAC | 1789 | 5702 |
| MPL | CD8SP-MPL-12E10-(vL-vH)-Myc-z-P2A-hNEMO-K277A-Flag-T2A-PAC | 1790 | 5703 |
| MPL | CD8SP-MPL-huVB22Bw5-(vL-vH)-Myc-z-P2A-hNEMO-K277A-Flag-T2A-PAC | 1791 | 5704 |
| Muc1/MHC class I complex | CD8SP-Muc1-D6-M3B8-(vL-vH)-Myc-z-P2A-hNEMO-K277A-Flag-T2A-PAC | 1792 | 5705 |
| Muc1/MHC class I complex | CD8SP-MUCl-D6-M3Al-(vL-vH)-Myc-z-P2A-hNEMO-K277A-Flag-T2A-PAC | 1793 | 5706 |
| Muc16 | CD8SP-Muc 16-4H11-(vL-vH)-Myc-z-P2A-hNEMO-K277A-Flag-T2A-PAC | 1794 | 5707 |
| EGFR | CD8SP-Nimotuzumab-(vL-vH)-Myc-z-P2A-hNEMO-K277A-Flag-T2A-PAC | 1795 | 5708 |
| NKG2D Ligand | CD8SP-NKG2D-(GGGGS-GGGGD)-Myc-z-P2A-hNEMO-K277A-Flag-T2A-PAC | 1796 | 5709 |
| NKG2D | CD8SP-NKG2D-MS-(vL-vH)-Myc-z-P2A-hNEMO-K277A-Flag-T2A-PAC | 1797 | 5710 |
| NY-BR1 | CD8SP-NYBR1-(vL-vH)-Myc-z-P2A-hNEMO-K277A-Flag-T2A-PAC | 1798 | 5711 |
| NY-ESO/MHC class I complex | CD8SP-NYESO-T1-(vL-vH)-Myc-z-P2A-hNEMO-K277A-Flag-T2A-PAC | 1799 | 5712 |
| NY-ESO/MHC class I complex | CD8SP-NYESO-T1-(vL-vH)-Myc-z-P2A-hNEMO-K277A-Flag-T2A-PAC | 1800 | 5713 |
| PD1 ligand (e.g., PDL1) | CD8SP-PD1-ECD-Myc-z-P2A-hNEMO-K277A-Flag-T2A-PAC | 1801 | 5714 |
| PDL1 | CD8SP-PDL1-Atezoli-(vL-vH)-Myc-z-P2A-hNEMO-K277A-Flag-T2A-PAC | 1802 | 5715 |
| PDL1 | CD8SP-PDL1-SP142-(vL-vH)-Myc-z-P2A-hNEMO-K277A-Flag-T2A-PAC | 1803 | 5716 |
| PDL1 | CD8SP-PDL1-10A5-(vL-vH)-Myc-z-P2A-hNEMO-K277A-Flag-T2A-PAC | 1804 | 5717 |
| PSCA (Prostate stem cell antigen) | CD8SP-PSCA-Ha14-121-(vL-vH)-Myc-z-P2A-hNEMO-K277A-Flag-T2A-PAC | 1805 | 5718 |
| PSCA (Prostate stem cell antigen) | CD8SP-PSCA-Ha14-117-(vL-vH)-Myc-z-P2A-hNEMO-K277A-Flag-T2A-PAC | 1806 | 5719 |
| PR1/MHC class I complex | CD8SP-PR1-(vL-vH)-Myc-z-P2A-hNEMO-K277A-Flag-T2A-PAC | 1807 | 5720 |
| PSMA (Prostate Specific Membrane Antigen) | CD8SP-PSMA-006-(vL-vH)-Myc-z-P2A-hNEMO-K277A-Flag-T2A-PAC | 1808 | 5721 |
| PSMA | CD8SP-PSMA-J591-(vL-vH)-Myc-z-P2A-hNEMO-K277A-Flag-T2A-PAC | 1809 | 5722 |
| PTK7 (Tyrosine-protein kinase-like 7) | CD8SP-PTK7-hSC6-23-(vL-vH)-Myc-z-P2A-hNEMO-K277A-Flag-T2A-PAC | 1810 | 5723 |

TABLE 12-continued

Exemplary Ist Generation CAR constructs coexpressing hNEMO-K277A
and PAC accessory modules. Both accessory modules are optional.

| Target | Name of CAR constructs including the name of antigen binding domain | SEQ ID NO (DNA) | SEQ ID NO (PRT) |
|---|---|---|---|
| PTK7 | CD8SP-PTK7-SC6-10-2-(vL-vH)-Myc-z-P2A-hNEMO-K277A-Flag-T2A-PAC | 1811 | 5724 |
| ROR1 | CD8SP-ROR1-4A5-(vL-vH)-Myc-z-P2A-hNEMO-K277A-Flag-T2A-PAC | 1812 | 5725 |
| ROR1 | CD8SP-ROR1-4C10-(vL-vH)-Myc-z-P2A-hNEMO-K277A-Flag-T2A-PAC | 1813 | 5726 |
| Mesothelin | CD8SP-SD1-vHH-Linker-SD2-vHH-Myc-z-P2A-hNEMO-K277A-Flag-T2A-PAC | 1814 | 5727 |
| SLea | CD8SP-SLea-7E3-(vL-vH)-Myc-z-P2A-hNEMO-K277A-Flag-T2A-PAC | 1815 | 5728 |
| SLea | CD8SP-SLea-5B1-(vL-vH)-Myc-z-P2A-hNEMO-K277A-Flag-T2A-PAC | 1816 | 5729 |
| SSEA4 (stage-specific embryonic antigen 4) | CD8SP-SSEA4-(vL-vH)-Myc-z-P2A-hNEMO-K277A-Flag-T2A-PAC | 1817 | 5730 |
| TCRB1 (TCR beta 1 constant chain) | CD8SP-TCRB1-CPO1-E09-(vL-vH)-Myc-z-P2A-hNEMO-K277A-Flag-T2A-PAC | 1818 | 5731 |
| TCRB1 | CD8SP-TCRB1-Jovi1-(vL-vH)-Myc-z-P2A-hNEMO-K277A-Flag-T2A-PAC | 1819 | 5732 |
| TCRB2 (TCRbeta 2 constant chain) | CD8SP-TCRB2-CP01-D05-(vL-vH)-Myc-z-P2A-hNEMO-K277A-Flag-T2A-PAC | 1820 | 5733 |
| TCRB2 | CD8SP-TCRB2-CP01-E05-(vL-vH)-Myc-z-P2A-hNEMO-K277A-Flag-T2A-PAC | 1821 | 5734 |
| TCRgd (TCR gamma/delta) | CD8SP-TCRgd-G5-4-(vL-vH)-Myc-z-P2A-hNEMO-K277A-Flag-T2A-PAC | 1822 | 5735 |
| hTERT/MHC class I complex | CD8SP-TERT-4A9-T540-(vL-vH)-Myc-z-P2A-hNEMO-K277A-Flag-T2A-PAC | 1823 | 5736 |
| hTERT/MHC class I complex | CD8SP-TERT-3G3-T865-(vL-vH)-Myc-z-P2A-hNEMO-K277A-Flag-T2A-PAC | 1824 | 5737 |
| Tissue Factor-1 | CD8SP-TGFBR2-Ab1-(vL-vH)-Myc-z-P2A-hNEMO-K277A-Flag-T2A-PAC | 1825 | 5738 |
| TGFBR2 | CD8SP-TF1-98-(vL-vH)-Myc-z-P2A-hNEMO-K277A-Flag-T2A-PAC | 1826 | 5739 |
| TIM1/HAVCR | CD8SP-TIM1-HVCR1-270-2-(vL-vH)-Myc-z-P2A-hNEMO-K277A-Flag-T2A-PAC | 1827 | 5740 |
| TIM1/HAVCR | CD8SP-TIM1-HVCR1-ARD5-(vL-vH)-Myc-z-P2A-hNEMO-K277A-Flag-T2A-PAC | 1828 | 5741 |
| TnAg | CD8SP-TnAg-(vL-vH)-Myc-z-P2A-hNEMO-K277A-Flag-T2A-PAC | 1829 | 5742 |
| Tn-Muc1 | CD8SP-TnMuc1-hu5E5-RHA8-RKA-2-(vL-vH)-Myc-z-P2A-hNEMO-K277A-Flag-T2A-PAC | 1830 | 5743 |
| MPL | CD8SP-hTPO-Myc-z-P2A-hNEMO-K277A-Flag-T2A-PAC | 1831 | 5744 |
| TROP2 (Trophoblast cell-surface antigen-2) | CD8SP-TROP2-ARA47-HV3KV3-(vL-vH)-Myc-z-P2A-hNEMO-K277A-Flag-T2A-PAC | 1832 | 5745 |
| TROP2 | CD8SP-TROP2-h7E6-SVG-(vL-vH)-Myc-z-P2A-hNEMO-K277A-Flag-T2A-PAC | 1833 | 5746 |
| TSHR | SP-TSHb-Linker-CGHa-Myc-z-P2A-hNEMO-K277A-Flag-T2A-PAC | 1834 | 5747 |
| TSHR | CD8SP-TSHR-K1-70-(vL-vH)-Myc-z-P2A-hNEMO-K277A-Flag-T2A-PAC | 1835 | 5748 |
| TSHR | CD8SP-TSHR-KB1-(vL-vH)-Myc-z-P2A-hNEMO-K277A-Flag-T2A-PAC | 1836 | 5749 |
| TSHR | CD8SP-TSHR-5C9-(vL-vH)-Myc-z-P2A-hNEMO-K277A-Flag-T2A-PAC | 1837 | 5750 |
| TSLPR (thymic stromal lymphopoietin receptor) | CD8SP-TSLPR-(vL-vH)-Myc-z-P2A-hNEMO-K277A-Flag-T2A-PAC | 1838 | 5751 |
| Tyrosinase/MHC class I complex | CD8SP-Tyros-B2-(vL-vH)-Myc-z-P2A-hNEMO-K277A-Flag-T2A-PAC | 1839 | 5752 |
| Tyrosinase/MHC class I complex | CD8SP-Tyros-MC1-(vL-vH)-Myc-z-P2A-hNEMO-K277A-Flag-T2A-PAC | 1840 | 5753 |
| Tyrosinase/MHC class I complex | CD8SP-Tyros-TA2-(vL-vH)-Myc-z-P2A-hNEMO-K277A-Flag-T2A-PAC | 1841 | 5754 |
| VEGFR3 | CD8SP-VEGFR3-Ab1-(vL-vH)-Myc-z-P2A-hNEMO-K277A-Flag-T2A-PAC | 1842 | 5755 |
| WT1/MHC class I complex | CD8SP-WT1-Ab1-(vL-vH)-Myc-z-P2A-hNEMO-K277A-Flag-T2A-PAC | 1843 | 5756 |
| WT1/MHC class I complex | CD8SP-WT1-Ab5-(vL-vH)-Myc-z-P2A-hNEMO-K277A-Flag-T2A-PAC | 1844 | 5757 |
| WT1/MHC class I | CD8SP-MYC3-WT1-Ab13-(vL-vH)-Myc-z-P2A- | 1845 | 5758 |

TABLE 12-continued

Exemplary Ist Generation CAR constructs coexpressing hNEMO-K277A
and PAC accessory modules. Both accessory modules are optional.

| Target | Name of CAR constructs including the name of antigen binding domain | SEQ ID NO (DNA) | SEQ ID NO (PRT) |
|---|---|---|---|
| complex | hNEMO-K277A-Flag-T2A-PAC | | |
| WT1/MHC class I complex | CD8SP-MYC3-WT1-Ab15-(vL-vH)-Myc-z-P2A-hNEMO-K277A-Flag-T2A-PAC | 1846 | 5759 |
| CDH19 | CD8SP-CDH19-4B10-(vL-vH)-Myc-z-P2A-hNEMO-K277A-Flag-T2A-PAC | 1847 | 5760 |
| Folate Receptor beta | CD8SP-FRbeta-m923-(vL-vH)-Myc-z-P2A-hNEMO-K277A-Flag-T2A-PAC | 1848 | 5761 |
| LHR (Luteinizing hormone Receptor) | CD8SP-LHR-8B7-(vL-vH)-Myc-z-P2A-hNEMO-K277A-Flag-T2A-PAC | 1849 | 5762 |
| LHR | CD8SP-LHR-5F4-21-(vL-vH)-Myc-z-P2A-hNEMO-K277A-Flag-T2A-PAC | 1850 | 5763 |
| B7H4 | CD8SP-B7H4-hu22C10-(vL-vH)-Myc-z-P2A-hNEMO-K277A-Flag-T2A-PAC | 1851 | 5764 |
| B7H4 | CD8SP-B7H4-hu1D11-(vL-vH)-Myc-z-P2A-hNEMO-K277A-Flag-T2A-PAC | 1852 | 5765 |
| IgE | CD8SP-IgE-omalizumab-(vL-vH)-Myc-z-P2A-hNEMO-K277A-Flag-T2A-PAC | 1853 | 5766 |
| CD23 | CD8SP-CD23-p5E8-(vL-vH)-Myc-z-P2A-hNEMO-K277A-Flag-T2A-PAC | 1854 | 5767 |
| GCC (Guanylyl cyclase C) | CD8SP-GCC-5F9-(vL-vH)-Myc-z-P2A-hNEMO-K277A-Flag-T2A-PAC | 1855 | 5768 |
| GCC | CD8SP-GCC-Ab229-(vL-vH)-Myc-z-P2A-hNEMO-K277A-Flag-T2A-PAC | 1856 | 5769 |
| CD200R | CD8SP-CD200R-huDx182-(vL-vH)-Myc-z-P2A-hNEMO-K277A-Flag-T2A-PAC | 1857 | 5770 |
| Tn-Muc1 | CD8SP-Tn-Muc1-5E5-HL-(vH-vL)-Myc-z-P2A-hNEMO-K277A-Flag-T2A-PAC | 1858 | 5771 |
| CD22 | CD8SP-CD22-5-HL-(vH-vL)-Myc-z-P2A-hNEMO-K277A-Flag-T2A-PAC | 1859 | 5772 |
| CD22 | CD8SP-CD22-10-HL-(vH-vL)-Myc-z-P2A-hNEMO-K277A-Flag-T2A-PAC | 1860 | 5773 |
| CD22 | CD8SP-CD22-31-HL-(vH-vL)-Myc-z-P2A-hNEMO-K277A-Flag-T2A-PAC | 1861 | 5774 |
| CD22 | CD8SP-CD22-53-HL-(vH-vL)-Myc-z-P2A-hNEMO-K277A-Flag-T2A-PAC | 1862 | 5775 |
| CD22 | CD8SP-CD22-65-HL-(vH-vL)-Myc-z-P2A-hNEMO-K277A-Flag-T2A-PAC | 1863 | 5776 |
| Tn-Muc1 | CD8SP-Tn-Muc1-5E5-(vH-vL)-Myc-z-P2A-hNEMO-K277A-Flag-T2A-PAC | 1864 | 5777 |
| Kappa Light Chain | CD8SP-Kappa-LC1-(vL-vH)-Myc-z-P2A-hNEMO-K277A-Flag-T2A-PAC | 1865 | 5778 |
| PTK7 | CD8SP-PTK7-7C8-(vL-vH)-Myc-z-P2A-hNEMO-K277A-Flag-T2A-PAC | 1866 | 5779 |
| PTK7 | CD8SP-PTK7-12C6a-(vL-vH)-Myc-z-P2A-hNEMO-K277A-Flag-T2A-PAC | 1867 | 5780 |
| CD19 | CD8SP-hCD19-EUK5-13-(vL-vH)-Myc-z-P2A-hNEMO-K277A-Flag-T2A-PAC | 1868 | 5781 |
| Ras | CD8SP-Ras-Ab2-(vL-vH)-Myc-z-P2A-hNEMO-K277A-Flag-T2A-PAC | 1869 | 5782 |
| Ras | CD8SP-Ras-Ab4-(vL-vH)-Myc-z-P2A-hNEMO-K277A-Flag-T2A-PAC | 1870 | 5783 |
| Claudin 18.2 | CD8SP-CLD18A2-43A11-(vL-vH)-Myc-z-P2A-hNEMO-K277A-Flag-T2A-PAC | 1871 | 5784 |
| Claudin 18.2 | CD8SP-CLD18A2-175D10-(vL-vH)-Myc-z-P2A-hNEMO-K277A-Flag-T2A-PAC | 1872 | 5785 |
| CD43 | CD8SP-CD43-huJL-1-257-10-(vL-vH)-Myc-z-P2A-hNEMO-K277A-Flag-T2A-PAC | 1873 | 5786 |
| CD69L | CD8SP-CD69L-DREG200-(vL-vH)-Myc-z-P2A-hNEMO-K277A-Flag-T2A-PAC | 1874 | 5787 |
| NY-ESO-1/MHC I complex | CD8SP-NYESO-35-15-(vL-vH)-Myc-z-P2A-hNEMO-K277A-Flag-T2A-PAC | 1875 | 5788 |
| Pgp | CD8SP-Pgp-9F11-(vH-vL)-Myc-z-P2A-hNEMO-K277A-Flag-T2A-PAC | 1876 | 5789 |
| Streptag | CD8SP-Streptag-(vL-vH)-Myc-z-P2A-hNEMO-K277A-Flag-T2A-PAC | 1877 | 5790 |
| MPL | CD8SP-MPL-Hu-161-2-(vL-vH)-Myc-z-P2A-hNEMO-K277A-Flag-T2A-PAC | 1878 | 5791 |
| Pgp | CD8SP-Pgp-MRK16-(vL-vH)-Myc-z-P2A-hNEMO-K277A-Flag-T2A-PAC | 1879 | 5792 |
| BCMA | CD8SP-BCMA-353-vHH-Myc-z-P2A-hNEMO-K277A-Flag-T2A-PAC | 1880 | 5793 |
| BCMA | CD8SP-BCMA-917-vHH-Myc-z-P2A-hNEMO-K277A-Flag-T2A-PAC | 1881 | 5794 |

TABLE 12-continued

Exemplary Ist Generation CAR constructs coexpressing hNEMO-K277A
and PAC accessory modules. Both accessory modules are optional.

| Target | Name of CAR constructs including the name of antigen binding domain | SEQ ID NO (DNA) | SEQ ID NO (PRT) |
|---|---|---|---|
| BCMA | CD8SP-BCMA-353-vHH-Linker-BCMA917-vHH-Myc-z-P2A-hNEMO-K277A-Flag-T2A-PAC | 1882 | 5795 |
| CD38 | CD8SP-CD38-717-vHH-Myc-z-P2A-hNEMO-K277A-Flag-T2A-PAC | 1883 | 5796 |
| BCMA | CD8SP-BCMA-346-vHH-Myc-z-P2A-hNEMO-K277A-Flag-T2A-PAC | 1884 | 5797 |
| CD38-BCMA | CD8SP-CD38-717-vHH-Ecoil-BCMA-346-vHH-Myc-z-P2A-hNEMO-K277A-Flag-T2A-PAC | 1885 | 5798 |
| BCMA | CD8SP-BCMA-348-vHH-Myc-z-P2A-hNEMO-K277A-Flag-T2A-PAC | 1886 | 5799 |
| CD38 | CD8SP-CD3 8-331-vHH-Myc-z-P2A-hNEMO-K277A-Flag-T2A-PAC | 1887 | 5800 |
| BCMA-CD38 | CD8SP-BCMA-vHH-348-Ecoil-CD38-331-vHH-Myc-z-P2A-hNEMO-K277A-Flag-T2A-PAC | 1888 | 5801 |
| CD19 | CD8SP-CD19-vHH-Myc-z-P2A-hNEMO-K277A-Flag-T2A-PAC | 1889 | 5802 |
| CD20 | CD8SP-CD20-vHH-Myc-z-P2A-hNEMO-K277A-Flag-T2A-PAC | 1890 | 5803 |
| CD19 | CD8SP-CD19-vHH-Linker-CD20-vHH-Myc-z-P2A-hNEMO-K277A-Flag-T2A-PAC | 1891 | 5804 |
| BCMA | CD8SP-BCMA-948-vHH-Myc-z-P2A-hNEMO-K277A-Flag-T2A-PAC | 1892 | 5805 |
| BCMA | CD8SP-BCMA-972-vHH-Myc-z-P2A-hNEMO-K277A-Flag-T2A-PAC | 1893 | 5806 |
| BCMA | CD8SP-BCMA-948-vHH-PG4SP-BCMA-972-vHH-Myc-z-P2A-hNEMO-K277A-Flag-T2A-PAC | 1894 | 5807 |
| BCMA | CD8SP-BCMA-948-vHH-PG4SP-BCMA-972-vHH-Ecoilx4-Myc-z-P2A-hNEMO-K277A-Flag-T2A-PAC | 1895 | 5808 |
| MPL | CD8SP-MPL-hu-175-2-(vL-vH)-Myc-z-P2A-hNEMO-K277A-Flag-T2A-PAC | 1896 | 5809 |
| MPL | CD8SP-MPL-hu-111-2-(vL-vH)-Myc-z-P2A-hNEMO-K277A-Flag-T2A-PAC | 1897 | 5810 |
| CD179a | CD8SP-CD179a-2460-B04-(vL-vH)-Myc-z-P2A-hNEMO-K277A-Flag-T2A-PAC | 1898 | 5811 |
| CD179a | CD8SP-CD179a-2462-E07-(vL-vH)-Myc-z-P2A-hNEMO-K277A-Flag-T2A-PAC | 1899 | 5812 |

40

TABLE 13

SEQ ID IDENTIFICATION OF CARS/BITES USING ANTIGEN BINDING DOMAINS
DESCRIBED FOR zCAR-NEMO-K277A (TABLE 12) AS A TEMPLATE

| CAR ARCHITECTURE | EXEMPLARY CAR/Bispecific T cell Engager | SEQ ID NO DNA | | SEQ ID NO PRT | |
|---|---|---|---|---|---|
| zCAR-NEMO-K277A | CD8SP-FMC63-(vL-vH)-Myc-z-P2A-hNEMO-K277A-Flag-T2A-PAC | 1594-1857 | 1858-1899 | 5507-5770 | 5771-5812 |
| zCAR-K13 | CD8SP-FMC63-(vL-vH)-Myc-z-P2A-K13-Flag-T2A-PAC | 1016-1285 | | 4929-5192 | |
| BBz CAR | CD8SP-FMC63-(vL-vH)-Myc-BBz-T2A-PAC | 1318-1581 | | 5231-5494 | |
| CD3ε-TFP-NEMO-K277A | CD8SP-FMC63-(vL-vH)-CD3e-ECDTMCP-opt2-P2A-hNEMO-K277A-Flag-T2A-PAC | 1900-2163 | 2164-2205 | 5813-6076 | 6077-6118 |
| CD3δ-TFP-NEMO-K277A | CD8SP-FMC63-(vL-vH)-CD3d-ECDTMCP-opt2-P2A-hNEMO-K277A-Flag-T2A-PAC | 2206-2469 | 2470-2511 | 6119-6382 | 6383-6424 |
| CDγ-TFP- | CD8SP-FMC63-(vL-vH)- | 2512-2775 | 2776-2817 | 6425-6688 | 6689-6730 |

TABLE 13-continued

SEQ ID IDENTIFICATION OF CARS/BITES USING ANTIGEN BINDING DOMAINS
DESCRIBED FOR zCAR-NEMO-K277A (TABLE 12) AS A TEMPLATE

| CAR ARCHITECTURE | EXEMPLARY CAR/Bispecific T cell Engager | SEQ ID NO DNA | | SEQ ID NO PRT | |
|---|---|---|---|---|---|
| NEMO-K277A | CD3z-ECDTMCP-opt2-P2A-hNEMO-K277A-Flag-T2A-PAC | | | | |
| CDζ-TFP-NEMO-K277A | CD8SP-FMC63-(vL-vH)-CD3z-ECDTMCP-opt2-P2A-hNEMO-K277A-Flag-T2A-PAC | 2818-3081 | 3082-3123 | 6731-6994 | 6995-7036 |
| Bispecific T cell Engager | CD8SP-FMC63-scFv-Linker-CD3-scFv-Myc-His | 3545-3814 | | 7458-7721 | |

20

25

30

35

40

45

50

55

60

65

TABLE 14

Ab-TCR CONSTRUCTS WITH DIFFERENT ANTIGEN BINDING DOMAINS.

| Target | Name of CAR constructs including the name of antigen binding domain | SEQ ID NO (DNA) | SEQ ID NO (PRT) |
|---|---|---|---|
| CD19 | CD8SP-FMC63-vL-[IgCL-TCRb-IAH-6MD]-F-P2A-SP-FMC63-vH-[IgG1-CH1-TCRa-SDVP-6MD]-F-F2A-hNEMO-K277A | 3124 | 7037 |
| CD19 | CD8SP-huFMC63-11-vL-[IgCL-TCRb-IAH-6MD]-F-P2A-SP-huFMC63-11-vH-[IgG1-CH1-TCRa-SDVP-6MD]-F-F2A-hNEMO-K277A | 3125 | 7038 |
| CD19 | CD8SP-CD19Bu12-vL-[IgCL-TCRb-IAH-6MD]-F-P2A-SP-CD19Bu12-vH-[IgG1-CH1-TCRa-SDVP-6MD]-F-F2A-hNEMO-K277A | 3126 | 7039 |
| CD19 | CD8SP2-CD19MM-vL-[IgCL-TCRb-IAH-6MD]-F-P2A-SP-CD19MM-vH-[IgG1-CH1-TCRa-SDVP-6MD]-F-F2A-hNEMO-K277A | 3127 | 7040 |
| CD19 | CD8SP-CD19-4G7-vL-[IgCL-TCRb-IAH-6MD]-F-P2A-SP-CD19-4G7-vH-[IgG1-CH1-TCRa-SDVP-6MD]-F-F2A-hNEMO-K277A | 3128 | 7041 |
| HIV1-env | CD8SP-HIV1-N6-vL-[IgCL-TCRb-IAH-6MD]-F-P2A-SP-HIV1-N6-vH-[IgG1-CH1-TCRa-SDVP-6MD]-F-F2A-hNEMO-K277A | 3129 | 7042 |
| ALK | CD8SP-Alk-48-vL-[IgCL-TCRb-IAH-6MD]-F-P2A-SP-Alk-48-vH-[IgG1-CH1-TCRa-SDVP-6MD]-F-F2A-hNEMO-K277A | 3130 | 7043 |
| ALK | CD8SP-Alk-58-vL-[IgCL-TCRb-IAH-6MD]-F-P2A-SP-Alk-5 8-vH-[IgG1-CH1-TCRa-SDVP-6MD]-F-F2A-hNEMO-K277A | 3131 | 7044 |
| Amyloid | SP-Amyloid-158-vL-[IgCL-TCRb-IAH-6MD]-F-P2A-SP-Amyloid-158-vH-[IgG1-CH1-TCRa-SDVP-6MD]-F-F2A-hNEMO-K277A | 3132 | 7045 |
| Biotin | CD8SP-dc-Avidin-[IgCL-TCRb-IAH-6MD]-F-P2A-SP-dc-Avidin-[IgG1-CH1-TCRa-SDVP-6MD]-F-F2A-hNEMO-K277A | 3133 | 7046 |
| CD45 | CD8SP-BC8-CD45-vL-[IgCL-TCRb-IAH-6MD]-F-P2A-SP-BC8-CD45-vH-[IgG1-CH1-TCRa-SDVP-6MD]-F-F2A-hNEMO-K277A | 3134 | 7047 |
| BCMA | CD8SP-BCMA-J6M0-vL-[IgCL-TCRb-IAH-6MD]-F-P2A-SP-BCMA-J6M0-vH-[IgG1-CH1-TCRa-SDVP-6MD]-F-F2A-hNEMO-K277A | 3135 | 7048 |
| BCMA | CD8SP-BCMA-huC12A3-L3H3-vL-[IgCL-TCRb-IAH-6MD]-F-P2A-SP-BCMA-huC12A3-L3H3-vH-[IgG1-CH1-TCRa-SDVP-6MD]-F-F2A-hNEMO-K277A | 3136 | 7049 |
| BCMA | CD8SP-BCMA-ET-40-vL-[IgCL-TCRb-IAH-6MD]-F-P2A-SP-BCMA-ET-40-vH-[IgG1-CH1-TCRa-SDVP-6MD]-F-F2A-hNEMO-K277A | 3137 | 7050 |
| BCMA | CD8SP-BCMA-ET-54-vL-[IgCL-TCRb-IAH-6MD]-F-P2A-SP-BCMA-ET-54-vH-[IgG1-CH1-TCRa-SDVP-6MD]-F-F2A-hNEMO-K277A | 3138 | 7051 |
| CCR4 | CD8SP-CCR4-humAb1567-vL-[IgCL-TCRb-IAH-6MD]-F-P2A-SP-CCR4-humAb1567-vH-[IgG1-CH1-TCRa-SDVP-6MD]-F-F2A-hNEMO-K277A | 3139 | 7052 |
| HIV1-env | CD8SP-CD4-ECD-[IgCL-TCRb-IAH-6MD]-F-P2A-SP-DC-SIGN-[IgG1-CH1-TCRa-SDVP-6MD]-F-F2A-hNEMO-K277A | 3140 | 7053 |
| CD5 | CD8SP-CD5-9-vL-[IgCL-TCRb-IAH-6MD]-F-P2A-SP-CD5-9-vH-[IgG1-CH1-TCRa-SDVP-6MD]-F-F2A-hNEMO-K277A | 3141 | 7054 |
| CD5 | CD8SP-CD5-18-vL-[IgCL-TCRb-IAH-6MD]-F-P2A-SP-CD5-18-vH-[IgG1-CH1-TCRa-SDVP-6MD]-F-F2A-hNEMO-K277A | 3142 | 7055 |
| IgFc | CD8SP-CD16A-V158-ECD-v1-[IgCL-TCRb-IAH-6MD]-P2A-CD8SP2-CD16A-V158-ECD-v2-[IgG1-CH1-TCRa-SDVP-6MD]-F-F2A-hNEMO-K277A | 3143 | 7056 |
| IgFc | CD8SP-CD16A-V158-ECD-v1-[IgCL-TCRb-IAH-6MD]-P2A-SP-CD123-1-[IgG1-CH1-TCRa-SDVP-6MD]-F-F2A-hNEMO-K277A | 3144 | 7057 |
| CD20 | CD8SP-CD20-2F2-vL-[IgCL-TCRb-IAH-6MD]-F-P2A-SP-CD20-2F2-vH-[IgG1-CH1-TCRa-SDVP-6MD]-F-F2A-hNEMO-K277A | 3145 | 7058 |
| CD20 | CD8SP-CD20-GA101-vL-[IgCL-TCRb-IAH-6MD]-F-P2A-SP-CD20-GA101-vH-[IgG1-CH1-TCRa-SDVP-6MD]-F-F2A-hNEMO-K277A | 3146 | 7059 |
| CD22 | CD8SP-CD22-h10F4v2-vL-[IgCL-TCRb-IAH-6MD]-F-P2A-SP-CD22-h10F4v2-vH-[IgG1-CH1-TCRa-SDVP-6MD]-F-F2A-hNEMO-K277A | 3147 | 7060 |
| CD22 | CD8SP-CD22-H22Rhov2ACDRKA-vL-[IgCL-TCRb-IAH-6MD]-F-P2A-SP-CD22-H22Rhov2ACDRKA- | 3148 | 7061 |

TABLE 14-continued

Ab-TCR CONSTRUCTS WITH DIFFERENT ANTIGEN BINDING DOMAINS.

| Target | Name of CAR constructs including the name of antigen binding domain | SEQ ID NO (DNA) | SEQ ID NO (PRT) |
|---|---|---|---|
| | vH-[IgG1-CH1-TCRa-SDVP-6MD]-F-F2A-hNEMO-K277A | | |
| CD22 | CD8SP-CD22-m971-vL-[IgCL-TCRb-IAH-6MD]-F-P2A-SP-CD22-m971-vH-[IgG1-CH1-TCRa-SDVP-6MD]-F-F2A-hNEMO-K277A | 3149 | 7062 |
| CD30 | CD8SP-CD30-5F11-vL-[IgCL-TCRb-IAH-6MD]-F-P2A-SP-CD30-5F11-vH-[IgG1-CH1-TCRa-SDVP-6MD]-F-F2A-hNEMO-K277A | 3150 | 7063 |
| CD30 | CD8SP-CD30-Ac10-vL-[IgCL-TCRb-IAH-6MD]-F-P2A-SP-CD30-Ac10-vH-[IgG1-CH1-TCRa-SDVP-6MD]-F-F2A-hNEMO-K277A | 3151 | 7064 |
| CD32 | CD8SP-CD32-Med9-vL-[IgCL-TCRb-IAH-6MD]-F-P2A-SP-CD32-Med9-vH-[IgG1-CH1-TCRa-SDVP-6MD]-F-F2A-hNEMO-K277A | 3152 | 7065 |
| CD33 | CD8SP-CD33-AF5-vL-[IgCL-TCRb-IAH-6MD]-F-P2A-SP-CD33-AF5-vH-[IgG1-CH1-TCRa-SDVP-6MD]-F-F2A-hNEMO-K277A | 3153 | 7066 |
| CD33 | CD8SP-CD33-huMyc9-vL-[IgCL-TCRb-IAH-6MD]-F-P2A-SP-CD33-huMyc9-vH-[IgG1-CH1-TCRa-SDVP-6MD]-F-F2A-hNEMO-K277A | 3154 | 7067 |
| CD34 | CD8SP-CD34-hu4C7-vL-[IgCL-TCRb-IAH-6MD]-F-P2A-SP-CD34-hu4C7-vH-[IgG1-CH1-TCRa-SDVP-6MD]-F-F2A-hNEMO-K277A | 3155 | 7068 |
| CD44v6 | CD8SP-CD44v6-Biwa8-vL-[IgCL-TCRb-IAH-6MD]-F-P2A-SP-CD44v6-Biwa8-vH-[IgG1-CH1-TCRa-SDVP-6MD]-F-F2A-hNEMO-K277A | 3156 | 7069 |
| CD70 | CD8SP-CD70-h1F6-vL-[IgCL-TCRb-IAH-6MD]-F-P2A-SP-CD70-h1F6-vH-[IgG1-CH1-TCRa-SDVP-6MD]-F-F2A-hNEMO-K277A | 3157 | 7070 |
| CD79b | CD8SP-CD79b-2F2-vL-[IgCL-TCRb-IAH-6MD]-F-P2A-SP-CD79b-2F2-vH-[IgG1-CH1-TCRa-SDVP-6MD]-F-F2A-hNEMO-K277A | 3158 | 7071 |
| CD123 | CD8SP-CD123-CSL362-vL-[IgCL-TCRb-IAH-6MD]-F-P2A-SP-CD123-CSL362-vH-[IgG1-CH1-TCRa-SDVP-6MD]-F-F2A-hNEMO-K277A | 3159 | 7072 |
| CD138 | CD8SP-CD138-vL-[IgCL-TCRb-IAH-6MD]-F-P2A-SP-CD138-vH-[IgG1-CH1-TCRa-SDVP-6MD]-F-F2A-hNEMO-K277A | 3160 | 7073 |
| CD179b | CD8SP-CD179b-vL-[IgCL-TCRb-IAH-6MD]-F-P2A-SP-CD179b-vH-[IgG1-CH1-TCRa-SDVP-6MD]-F-F2A-hNEMO-K277A | 3161 | 7074 |
| CD276 | CD8SP-CD276-17-vL-[IgCL-TCRb-IAH-6MD]-F-P2A-SP-CD276-17-vH-[IgG1-CH1-TCRa-SDVP-6MD]-F-F2A-hNEMO-K277A | 3162 | 7075 |
| CD324 | CD8SP-CD324-SC10-6-vL-[IgCL-TCRb-IAH-6MD]-F-P2A-SP-CD324-SC10-6-vH-[IgG1-CH1-TCRa-SDVP-6MD]-F-F2A-hNEMO-K277A | 3163 | 7076 |
| CD324 | CD8SP-CD324-hSC10-17-vL-[IgCL-TCRb-IAH-6MD]-F-P2A-SP-CD324-hSC10-17-vH-[IgG1-CH1-TCRa-SDVP-6MD]-F-F2A-hNEMO-K277A | 3164 | 7077 |
| CDH6 | CD8SP-CDH6-NOV710-vL-[IgCL-TCRb-IAH-6MD]-F-P2A-SP-CDH6-NOV710-vH-[IgG1-CH1-TCRa-SDVP-6MD]-F-F2A-hNEMO-K277A | 3165 | 7078 |
| CDH6 | CD8SP-CDH6-NOV712-vL-[IgCL-TCRb-IAH-6MD]-F-P2A-SP-CDH6-NOV712-vH-[IgG1-CH1-TCRa-SDVP-6MD]-F-F2A-hNEMO-K277A | 3166 | 7079 |
| CDH17 | CD8SP-CDH17-PTA001A4-vL-[IgCL-TCRb-IAH-6MD]-F-P2A-SP-CDH17-PTA001A4-vH-[IgG1-CH1-TCRa-SDVP-6MD]-F-F2A-hNEMO-K277A | 3167 | 7080 |
| CDH19 | CD8SP-CDH19-16A4-vL-[IgCL-TCRb-IAH-6MD]-F-P2A-SP-CDH19-16A4-vH-[IgG1-CH1-TCRa-SDVP-6MD]-F-F2A-hNEMO-K277A | 3168 | 7081 |
| EGFR | CD8SP-Cetuximab-vL-[IgCL-TCRb-IAH-6MD]-F-P2A-SP-Cetuximab-vH-[IgG1-CH1-TCRa-SDVP-6MD]-F-F2A-hNEMO-K277A | 3169 | 7082 |
| CLEC5A | CD8SP-CLEC5A-8H8F5-vL-[IgCL-TCRb-IAH-6MD]-F-P2A-SP-CLEC5A-8H8F5-vH-[IgG1-CH1-TCRa-SDVP-6MD]-F-F2A-hNEMO-K277A | 3170 | 7083 |
| CLEC5A | CD8SP-CLEC5A-3E12A2-vL-[IgCL-TCRb-IAH-6MD]-F-P2A-SP-CLEC5A-3E12A2-vH-[IgG1-CH1-TCRa-SDVP-6MD]-F-F2A-hNEMO-K277A | 3171 | 7084 |
| GR/LHR | SP-CGHb-[IgCL-TCRb-IAH-6MD]-F-P2A-SP-CGHa-[IgG1-CH1-TCRa-SDVP-6MD]-F-F2A-hNEMO-K277A | 3172 | 7085 |
| CLL1 | CD8SP-CLL1-M26-vL-[IgCL-TCRb-IAH-6MD]-F- | 3173 | 7086 |

TABLE 14-continued

Ab-TCR CONSTRUCTS WITH DIFFERENT ANTIGEN BINDING DOMAINS.

| Target | Name of CAR constructs including the name of antigen binding domain | SEQ ID NO (DNA) | SEQ ID NO (PRT) |
|---|---|---|---|
| CLL1 | P2A-SP-CLL1-M26-vH-[IgG1-CH1-TCRa-SDVP-6MD]-F-F2A-hNEMO-K277A CD8SP-CLL1-M32-vL-[IgCL-TCRb-IAH-6MD]-F-P2A-SP-CLL1-M32-vH-[IgG1-CH1-TCRa-SDVP-6MD]-F-F2A-hNEMO-K277A | 3174 | 7087 |
| CMVpp65 | CD8SP-CMVpp65-F5-vL-[IgCL-TCRb-IAH-6MD]-F-P2A-SP-CMVpp65-F5-vH-[IgG1-CH1-TCRa-SDVP-6MD]-F-F2A-hNEMO-K277A | 3175 | 7088 |
| CS1 | CD8SP-CS1-huLuc63-vL-[IgCL-TCRb-IAH-6MD]-F-P2A-SP-huLuc63-vH-[IgG1-CH1-TCRa-SDVP-6MD]-F-F2A-hNEMO-K277A | 3176 | 7089 |
| CS1 | CD8SP-HuLuc64-vL-[IgCL-TCRb-IAH-6MD]-F-P2A-SP-HuLuc64-vH-[IgG1-CH1-TCRa-SDVP-6MD]-F-F2A-hNEMO-K277A | 3177 | 7090 |
| CS1 | CD8SP-CS1-huLuc90-vL-[IgCL-TCRb-IAH-6MD]-F-P2A-SP-huLuc90-vH-[IgG1-CH1-TCRa-SDVP-6MD]-F-F2A-hNEMO-K277A | 3178 | 7091 |
| CSF2RA | CD8SP-CSF2RA-Ab6-vL-[IgCL-TCRb-IAH-6MD]-F-P2A-SP-CSF2RA-Ab6-vH-[IgG1-CH1-TCRa-SDVP-6MD]-F-F2A-hNEMO-K277A | 3179 | 7092 |
| CSF2RA | CD8SP-CSF2RA-Ab1-vL-[IgCL-TCRb-IAH-6MD]-F-P2A-SP-CSF2RA-Ab1-vH-[IgG1-CH1-TCRa-SDVP-6MD]-F-F2A-hNEMO-K277A | 3180 | 7093 |
| CD123 | IgHSP-CD123-2-vHH-[IgCL-TCRb-IAH-6MD]-F-P2A-SP-CD123-1-vHH-[IgG1-CH1-TCRa-SDVP-6MD]-F-F2A-hNEMO-K277A | 3181 | 7094 |
| CD123 & IgFc | IgHSP-CD123-2-vHH-[IgCL-TCRb-IAH-6MD]-F-P2A-CD8SP1-CD16A-V158-ECD-v1-[IgG1-CH1-TCRa-SDVP-6MD]-F-F2A-hNEMO-K277A | 3182 | 7095 |
| CD123 & IgFc | IgHSP-CD123-2-vHH-[IgCL-TCRb-IAH-6MD]-F-P2A-CD8SP2-CD16A-V158-ECD-v2-[IgG1-CH1-TCRa-SDVP-6MD]-F-F2A-hNEMO-K277A | 3183 | 7096 |
| CD123 & MPL | IgHSP-CD123-2-vHH-[IgCL-TCRb-IAH-6MD]-F-P2A-CD8SP-MPL-161-HL-[IgG1-CH1-TCRa-SDVP-6MD]-F-F2A-hNEMO-K277A | 3184 | 7097 |
| CXCR4 & CD123 | CD8SP-CXCR4-1-vHH-[IgCL-TCRb-IAH-6MD]-F-P2A-SP-CD123-1-vHH-[IgG1-CH1-TCRa-SDVP-6MD]-F-F2A-hNEMO-K277A | 3185 | 7098 |
| CXCR4 & CD123 | CD8SP-CXCR4-2-VHH-[IgCL-TCRb-IAH-6MD]-F-P2A-SP-CD123-2-VHH-[IgG1-CH1-TCRa-SDVP-6MD]-F-F2A-hNEMO-K277A | 3186 | 7099 |
| DLL3 | CD8SP-DLL3-hSC16-13-vL-[IgCL-TCRb-IAH-6MD]-F-P2A-SP-DLL3-hSC16-13-vH-[IgG1-CH1-TCRa-SDVP-6MD]-F-F2A-hNEMO-K277A | 3187 | 7100 |
| DLL3 | CD8SP-DLL3-hSC16-56-vL-[IgCL-TCRb-IAH-6MD]-F-P2A-SP-DLL3-hSC16-56-vH-[IgG1-CH1-TCRa-SDVP-6MD]-F-F2A-hNEMO-K277A | 3188 | 7101 |
| EBNA3c | CD8SP-EBNA3c-315-vL-[IgCL-TCRb-IAH-6MD]-F-P2A-SP-EBNA3c-315-vH-[IgG1-CH1-TCRa-SDVP-6MD]-F-F2A-hNEMO-K277A | 3189 | 7102 |
| EBV-gp350 | CD8SP-EBV-gp350-vL-[IgCL-TCRb-IAH-6MD]-F-P2A-SP-EBV-gp3 50-vH-[IgG1-CH1-TCRa-SDVP-6MD]-F-F2A-hNEMO-K277A | 3190 | 7103 |
| EGFR | CD8SP-EGFR1-vHH-[IgCL-TCRb-IAH-6MD]-F-P2A-SP-CEA1-vHH-[IgG1-CH1-TCRa-SDVP-6MD]-F-F2A-hNEMO-K277A | 3191 | 7104 |
| EGFR | CD8SP-EGFR33-vHH-[IgCL-TCRb-IAH-6MD]-F-P2A-SP-CEA5-vHH-[IgG1-CH1-TCRa-SDVP-6MD]-F-F2A-hNEMO-K277A | 3192 | 7105 |
| EGFRvIII | CD8SP-EGFRvIII-139-vL-[IgCL-TCRb-IAH-6MD]-F-P2A-SP-EGFRvIII-139-vH-[IgG1-CH1-TCRa-SDVP-6MD]-F-F2A-hNEMO-K277A | 3193 | 7106 |
| EGFRvIII | CD8SP-EGFRvIII-2173-vH-[IgCL-TCRb-IAH-6MD]-F-P2A-SP-EGFRvIII-2173-vH-[IgG1-CH1-TCRa-SDVP-6MD]-F-F2A-hNEMO-K277A | 3194 | 7107 |
| EpCam1 | CD8SP-Epcam1-MM1-vL-[IgCL-TCRb-IAH-6MD]-F-P2A-SP-Epcam1-MM1-vH-[IgG1-CH1-TCRa-SDVP-6MD]-F-F2A-hNEMO-K277A | 3195 | 7108 |
| EpCam1 | CD8SP-Epcam1-D5K5-vL-[IgCL-TCRb-IAH-6MD]-F-P2A-SP-Epcam1-D5K5-vH-[IgG1-CH1-TCRa-SDVP-6MD]-F-F2A-hNEMO-K277A | 3196 | 7109 |
| FLT3 | CD8SP-FLT3-NC7-vL-[IgCL-TCRb-IAH-6MD]-F-P2A-SP-FLT3-NC7-vH-[IgG1-CH1-TCRa-SDVP-6MD]-F-F2A-hNEMO-K277A | 3197 | 7110 |
| FITC | CD8SP-FITC-vL-[IgCL-TCRb-IAH-6MD]-F-P2A-SP- | 3198 | 7111 |

TABLE 14-continued

| | Ab-TCR CONSTRUCTS WITH DIFFERENT ANTIGEN BINDING DOMAINS. | | |
|---|---|---|---|
| Target | Name of CAR constructs including the name of antigen binding domain | SEQ ID NO (DNA) | SEQ ID NO (PRT) |
| | FITC-vH-[IgG1-CH1-TCRa-SDVP-6MD]-F-F2A-hNEMO-K277A | | |
| Influenza A HA | CD8SP-FLU-MEDI-8852-vL-[IgCL-TCRb-IAH-6MD]-F-P2A-SP-FLU-MEDI-8852-vH-[IgG1-CH1-TCRa-SDVP-6MD]-F-F2A-hNEMO-K277A | 3199 | 7112 |
| Folate Receptor 1 | CD8SP-FR1-huMov19-vL-[IgCL-TCRb-IAH-6MD]-F-P2A-SP-FR1-huMov19-vH-[IgG1-CH1-TCRa-SDVP-6MD]-F-F2A-hNEMO-K277A | 3200 | 7113 |
| FSHR | CD8SP-FSHb-vL-[IgCL-TCRb-IAH-6MD]-F-P2A-SP-CGHa-vH-[IgG1-CH1-TCRa-SDVP-6MD]-F-F2A-hNEMO-K277A | 3201 | 7114 |
| GD2 | CD8SP-GD2-hu14-18-vL-[IgCL-TCRb-IAH-6MD]-F-P2A-SP-GD2-hu14-18-vH-[IgG1-CH1-TCRa-SDVP-6MD]-F-F2A-hNEMO-K277A | 3202 | 7115 |
| GD2 | CD8SP-GD2-hu3F8-vL-[IgCL-TCRb-IAH-6MD]-F-P2A-SP-GD2-hu3F8-vH-[IgG1-CH1-TCRa-SDVP-6MD]-F-F2A-hNEMO-K277A | 3203 | 7116 |
| GD3 | CD8SP-GD3-KM-641-vL-[IgCL-TCRb-IAH-6MD]-F-P2A-SP-GD3-KM-641-vH-[IgG1-CH1-TCRa-SDVP-6MD]-F-F2A-hNEMO-K277A | 3204 | 7117 |
| GFRa4 | CD8SP-GFRAlpha4-P4-6-vL-[IgCL-TCRb-IAH-6MD]-F-P2A-SP-GFRAlpha4-P4-6-vH-[IgG1-CH1-TCRa-SDVP-6MD]-F-F2A-hNEMO-K277A | 3205 | 7118 |
| GFRa4 | CD8SP-GFRa4-P4-10-vL-[IgCL-TCRb-IAH-6MD]-F-P2A-SP-GFRa4-P4-10-vH-[IgG1-CH1-TCRa-SDVP-6MD]-F-F2A-hNEMO-K277A | 3206 | 7119 |
| FUCOSYL-GM1 | CD8SP-GM1-5B2-vL-[IgCL-TCRb-IAH-6MD]-F-P2A-SP-GM1-5B2-vH-[IgG1-CH1-TCRa-SDVP-6MD]-F-F2A-hNEMO-K277A | 3207 | 7120 |
| FUCOSYL-GM1 | CD8SP-GM1-7E5-vL-[IgCL-TCRb-IAH-6MD]-F-P2A-SP-GM1-7E5-vH-[IgG1-CH1-TCRa-SDVP-6MD]-F-F2A-hNEMO-K277A | 3208 | 7121 |
| GPRC5D | CD8SP-GPRC5D-ET150-5-vL-[IgCL-TCRb-IAH-6MD]-F-P2A-SP-GPRC5D-ET150-5-vH-[IgG1-CH1-TCRa-SDVP-6MD]-F-F2A-hNEMO-K277A | 3209 | 7122 |
| GPRC5D | CD8SP-GPRC5D-ET150-18-vL-[IgCL-TCRb-IAH-6MD]-F-P2A-SP-GPRC5D-ET150-18-vH-[IgG1-CH1-TCRa-SDVP-6MD]-F-F2A-hNEMO-K277A | 3210 | 7123 |
| gp100 | CD8SP-gp100-vL-[IgCL-TCRb-IAH-6MD]-F-P2A-SP-gp100-vH-[IgG1-CH1-TCRa-SDVP-6MD]-F-F2A-hNEMO-K277A | 3211 | 7124 |
| gp100 | CD8SP-gp100-G2D12-vL-[IgCL-TCRb-IAH-6MD]-F-P2A-SP-gp100-G2D12-vH-[IgG1-CH1-TCRa-SDVP-6MD]-F-F2A-hNEMO-K277A | 3212 | 7125 |
| GPC3 | CD8SP-GPC3-4E5-vL-[IgCL-TCRb-IAH-6MD]-F-P2A-SP-GPC3-4E5-vH-[IgG1-CH1-TCRa-SDVP-6MD]-F-F2A-hNEMO-K277A | 3213 | 7126 |
| gpNMB | CD8SP-gpNMB-115-vL-[IgCL-TCRb-IAH-6MD]-F-P2A-SP-gpNMB-115-vH-[IgG1-CH1-TCRa-SDVP-6MD]-F-F2A-hNEMO-K277A | 3214 | 7127 |
| GRP78 | CD8SP-GRP78-GC18-vL-[IgCL-TCRb-IAH-6MD]-F-P2A-SP-GRP78-GC18-vH-[IgG1-CH1-TCRa-SDVP-6MD]-F-F2A-hNEMO-K277A | 3215 | 7128 |
| Her2 | CD8SP-Her2-1-Darpin-[IgCL-TCRb-IAH-6MD]-F-P2A-SP-Her2-2-Darpin-[IgG1-CH1-TCRa-SDVP-6MD]-F-F2A-hNEMO-K277A | 3216 | 7129 |
| Her2 | CD8SP-Her2-5F7-vHH-[IgCL-TCRb-IAH-6MD]-F-P2A-SP-Her2-47D5-vHH-[IgG1-CH1-TCRa-SDVP-6MD]-F-F2A-hNEMO-K277A | 3217 | 7130 |
| Her2 | CD8SP-Her2-Hu4D5-vL-[IgCL-TCRb-IAH-6MD]-F-P2A-SP-Her2-Hu4D5-vH-[IgG1-CH1-TCRa-SDVP-6MD]-F-F2A-hNEMO-K277A | 3218 | 7131 |
| Her2 & Her3 | CD8SP-Her3-17B05So-vHH-[IgCL-TCRb-IAH-6MD]-F-P2A-SP-Her2-2D3-vHH-[IgG1-CH1-TCRa-SDVP-6MD]-F-F2A-hNEMO-K277A | 3219 | 7132 |
| HIV1-gag | CD8SP-HIV1-E5-vL-[IgCL-TCRb-IAH-6MD]-F-P2A-SP-HIV1-E5-vH-[IgG1-CH1-TCRa-SDVP-6MD]-F-F2A-hNEMO-K277A | 3220 | 7133 |
| HIV1-env | CD8SP-HIV1-3BNC117-vL-[IgCL-TCRb-IAH-6MD]-F-P2A-SP-HIV1-3BNC117-vH-[IgG1-CH1-TCRa-SDVP-6MD]-F-F2A-hNEMO-K277A | 3221 | 7134 |
| HIV1-env | CD8SP-HIV1-PGT-128-vL-[IgCL-TCRb-IAH-6MD]-F-P2A-SP-vH-[IgG1-CH1-TCRa-SDVP-6MD]-F-F2A-hNEMO-K277A | 3222 | 7135 |
| HIV1-env | CD8SP-HIV1-VR-C01-vL-[IgCL-TCRb-IAH-6MD]- | 3223 | 7136 |

TABLE 14-continued

| Target | Name of CAR constructs including the name of antigen binding domain | SEQ ID NO (DNA) | SEQ ID NO (PRT) |
|---|---|---|---|
| | F-P2A-SP-HIV1-VR-C01-vH-[IgG1-CH1-TCRa-SDVP-6MD]-F-F2A-hNEMO-K277A | | |
| HIV1-env | CD8SP-HIV1-X5-vL-[IgCL-TCRb-IAH-6MD]-F-P2A-SP-HIV1-X5-vH-[IgG1-CH1-TCRa-SDVP-6MD]-F-F2A-hNEMO-K277A | 3224 | 7137 |
| HMW-MAA | CD8SP-HMW-MAA-hIND-vL-[IgCL-TCRb-IAH-6MD]-F-P2A-SP-HMW-MAA-hIND-vH-[IgG1-CH1-TCRa-SDVP-6MD]-F-F2A-hNEMO-K277A | 3225 | 7138 |
| HTLV1-TAX | CD8SP-HTLV-TAX-T3F2-vL-[IgCL-TCRb-IAH-6MD]-F-P2A-SP-TAX-T3F2-vH-[IgG1-CH1-TCRa-SDVP-6MD]-F-F2A-hNEMO-K277A | 3226 | 7139 |
| HTLV1-TAX | CD8SP-HTLV-TAX-T3E3-vL-[IgCL-TCRb-IAH-6MD]-F-P2A-SP-TAX-T3E3-vH-[IgG1-CH1-TCRa-SDVP-6MD]-F-F2A-hNEMO-K277A | 3227 | 7140 |
| IL11Ra | CD8SP-IL11Ra-8E2-Ts107-vL-[IgCL-TCRb-IAH-6MD]-F-P2A-SP-IL11Ra-8E2-Ts107-vH-[IgG1-CH1-TCRa-SDVP-6MD]-F-F2A-hNEMO-K277A | 3228 | 7141 |
| IL6Ra & CD19 | IgHSP-IL6R-304-vHH-[IgCL-TCRb-IAH-6MD]-F-P2A-SP-FMC63-scFV-[IgG1-CH1-TCRa-SDVP-6MD]-F-F2A-hNEMO-K277A | 3229 | 7142 |
| IL13Ra2 | CD8SP-IL13Ra2-hu107-vL-[IgCL-TCRb-IAH-6MD]-F-P2A-SP-IL13Ra2-hu107vH-[IgG1-CH1-TCRa-SDVP-6MD]-F-F2A-hNEMO-K277A | 3230 | 7143 |
| IL13Ra2 | CD8SP-IL13Ra2-Hu108-vL-[IgCL-TCRb-IAH-6MD]-F-P2A-SP-IL13Ra2-Hu108-vH-[IgG1-CH1-TCRa-SDVP-6MD]-F-F2A-hNEMO-K277A | 3231 | 7144 |
| KSHV-K8.1 | CD8SP-KSHV-4C3-vL-[IgCL-TCRb-IAH-6MD]-F-P2A-SP-4C3-vH-[IgG1-CH1-TCRa-SDVP-6MD]-F-F2A-hNEMO-K277A | 3232 | 7145 |
| LAMP1 | CD8SP-LAMP1-humab1-2-vL-[IgCL-TCRb-IAH-6MD]-F-P2A-SP-LAMP1-humab1-2vH-[IgG1-CH1-TCRa-SDVP-6MD]-F-F2A-hNEMO-K277A | 3233 | 7146 |
| LAMP1 | CD8SP-LAMP1-Mb4-vL-[IgCL-TCRb-IAH-6MD]-F-P2A-SP-LAMP1-Mb4-vH-[IgG1-CH1-TCRa-SDVP-6MD]-F-F2A-hNEMO-K277A | 3234 | 7147 |
| LewisY | CD8SP-LewisY-huS193-vL-[IgCL-TCRb-IAH-6MD]-F-P2A-SP-LewisY-huS193-vH-[IgG1-CH1-TCRa-SDVP-6MD]-F-F2A-hNEMO-K277A | 3235 | 7148 |
| L1CAM | CD8SP-L1CAM-9-3-HU3-vL-[IgCL-TCRb-IAH-6MD]-F-P2A-SP-L1CAM-9-3-HU3-vH-[IgG1-CH1-TCRa-SDVP-6MD]-F-F2A-hNEMO-K277A | 3236 | 7149 |
| LHR | SP-LHb-[IgCL-TCRb-IAH-6MD]-F-P2A-SP-CGHa-[IgG1-CH1-TCRa-SDVP-6MD]-F-F2A-hNEMO-K277A | 3237 | 7150 |
| Lym1 | CD8SP-Lym1-vL-[IgCL-TCRb-IAH-6MD]-F-P2A-SP-Lym1-vH-[IgG1-CH1-TCRa-SDVP-6MD]-F-F2A-hNEMO-K277A | 3238 | 7151 |
| Lym2 | CD8SP-Lym2-vL-[IgCL-TCRb-IAH-6MD]-F-P2A-SP-Lym2-vH-[IgG1-CH1-TCRa-SDVP-6MD]-F-F2A-hNEMO-K277A | 3239 | 7152 |
| CD79b | CD8SP-huMA79bv28-vL-[IgCL-TCRb-IAH-6MD]-F-P2A-SP-huMA79bv28-vH-[IgG1-CH1-TCRa-SDVP-6MD]-F-F2A-hNEMO-K277A | 3240 | 7153 |
| MART1 | CD8SP-MART1-CAG10-vL-[IgCL-TCRb-IAH-6MD]-F-P2A-SP-MART1-CAG10-vH-[IgG1-CH1-TCRa-SDVP-6MD]-F-F2A-hNEMO-K277A | 3241 | 7154 |
| MART1 | CD8SP-MART1-CLA12-vL-[IgCL-TCRb-IAH-6MD]-F-P2A-SP-MART1-CLA12-vH-[IgG1-CH1-TCRa-SDVP-6MD]-F-F2A-hNEMO-K277A | 3242 | 7155 |
| Mesothelin | CD8SP-Mesothelin-m912-vL-[IgCL-TCRb-IAH-6MD]-F-P2A-SP-m912-vH-[IgG1-CH1-TCRa-SDVP-6MD]-F-F2A-hNEMO-K277A | 3243 | 7156 |
| cMet | CD8SP-cMET-171-vHH-[IgCL-TCRb-IAH-6MD]-F-P2A-SP-Her3-21F06-vHH-[IgG1-CH1-TCRa-SDVP-6MD]-F-F2A-hNEMO-K277A | 3244 | 7157 |
| MPL | CD8SP-MPL-175-vL-[IgCL-TCRb-IAH-6MD]-F-P2A-SP-175-vH-[IgG1-CH1-TCRa-SDVP-6MD]-F-F2A-hNEMO-K277A | 3245 | 7158 |
| MPL | CD8SP-MPL-161-vL-[IgCL-TCRb-IAH-6MD]-F-P2A-SP-161-vH-[IgG1-CH1-TCRa-SDVP-6MD]-F-F2A-hNEMO-K277A | 3246 | 7159 |
| MPL | CD8SP2-MPL-111-vL-[IgCL-TCRb-IAH-6MD]-F-P2A-SP-MPL-111-vH-[IgG1-CH1-TCRa-SDVP-6MD]-F-F2A-hNEMO-K277A | 3247 | 7160 |
| MPL | CD8SP-MPL-178-vL-[IgCL-TCRb-IAH-6MD]-F- | 3248 | 7161 |

TABLE 14-continued

Ab-TCR CONSTRUCTS WITH DIFFERENT ANTIGEN BINDING DOMAINS.

| Target | Name of CAR constructs including the name of antigen binding domain | SEQ ID NO (DNA) | SEQ ID NO (PRT) |
|---|---|---|---|
| | P2A-SP-178-vH-[IgG1-CH1-TCRa-SDVP-6MD]-F-F2A-hNEMO-K277A | | |
| MPL | CD8SP-MPL-AB317-vL-[IgCL-TCRb-IAH-6MD]-F-P2A-SP-AB317-vH-[IgG1-CH1-TCRa-SDVP-6MD]-F-F2A-hNEMO-K277A | 3249 | 7162 |
| MPL | CD8SP-MPL-12E10-vL-[IgCL-TCRb-IAH-6MD]-F-P2A-SP-12E10-vH-[IgG1-CH1-TCRa-SDVP-6MD]-F-F2A-hNEMO-K277A | 3250 | 7163 |
| MPL | CD8SP-MPL-huVB22Bw5-vL-[IgCL-TCRb-IAH-6MD]-F-P2A-SP-MPL-huVB22Bw5-vH-[IgG1-CH1-TCRa-SDVP-6MD]-F-F2A-hNEMO-K277A | 3251 | 7164 |
| Muc1 | CD8SP-Muc1-D6-M3B8-vL-[IgCL-TCRb-IAH-6MD]-F-P2A-SP-Muc1-D6-M3B8-vH-[IgG1-CH1-TCRa-SDVP-6MD]-F-F2A-hNEMO-K277A | 3252 | 7165 |
| Muc1 | CD8SP-MUC1-D6-M3A1-vL-[IgCL-TCRb-IAH-6MD]-F-P2A-SP-MUC1-D6-M3A1-vH-[IgG1-CH1-TCRa-SDVP-6MD]-F-F2A-hNEMO-K277A | 3253 | 7166 |
| Muc16 | CD8SP-Muc16-4H11-vL-[IgCL-TCRb-IAH-6MD]-F-P2A-SP-Muc16-4H11-vH-[IgG1-CH1-TCRa-SDVP-6MD]-F-F2A-hNEMO-K277A | 3254 | 7167 |
| EGFR | CD8SP-Nimotuzumab-vL-[IgCL-TCRb-IAH-6MD]-F-P2A-SP-Nimotuzumab-vH-[IgG1-CH1-TCRa-SDVP-6MD]-F-F2A-hNEMO-K277A | 3255 | 7168 |
| NKG2D | CD8SP-NKG2D-(G4SG4D)-[IgCL-TCRb-IAH-6MD]-F-P2A-SP-NKG2D-(G4SG4D)-v2-[IgG1-CH1-TCRa-SDVP-6MD]-F-F2A-hNEMO-K277A | 3256 | 7169 |
| NKG2D | CD8SP-NKG2D-MS-vL-[IgCL-TCRb-IAH-6MD]-F-P2A-SP-NKG2D-MS-vH-[IgG1-CH1-TCRa-SDVP-6MD]-F-F2A-hNEMO-K277A | 3257 | 7170 |
| NYBR1 | CD8SP-NYBR1-vL-[IgCL-TCRb-IAH-6MD]-F-P2A-SP-NYBR1-vH-[IgG1-CH1-TCRa-SDVP-6MD]-F-F2A-hNEMO-K277A | 3258 | 7171 |
| NY-ESO | CD8SP-NYESO-T1-vL-[IgCL-TCRb-IAH-6MD]-F-P2A-SP-NYESO-T1-vH-[IgG1-CH1-TCRa-SDVP-6MD]-F-F2A-hNEMO-K277A | 3259 | 7172 |
| NY-ESO | CD8SP-NYESO-T1-vL-[IgCL-TCRb-IAH-6MD]-F-P2A-SP-NYESO-T2-vH-[IgG1-CH1-TCRa-SDVP-6MD]-F-F2A-hNEMO-K277A | 3260 | 7173 |
| PD1 Ligand | SP-PD1-ECD-[IgCL-TCRb-IAH-6MD]-P2A-SP-PD1-opt-ECD-[IgG1-CH1-TCRa-SDVP-6MD]-F-F2A-hNEMO-K277A | 3261 | 7174 |
| PDL1 | CD8SP-PDL1-Atezoli-vL-[IgCL-TCRb-IAH-6MD]-F-P2A-SP-PDL1-Atezoli-vH-[IgG1-CH1-TCRa-SDVP-6MD]-F-F2A-hNEMO-K277A | 3262 | 7175 |
| PDL1 | CD8SP-PDL1-SP142-vL-[IgCL-TCRb-IAH-6MD]-F-P2A-SP-PDL1-SP142-vH-[IgG1-CH1-TCRa-SDVP-6MD]-F-F2A-hNEMO-K277A | 3263 | 7176 |
| PDL1 | CD8SP-PDL1-10A5-vL-[IgCL-TCRb-IAH-6MD]-F-P2A-SP-PDL1-10A5-vH-[IgG1-CH1-TCRa-SDVP-6MD]-F-F2A-hNEMO-K277A | 3264 | 7177 |
| PSCA | CD8SP-PSCA-Ha14-121-vL-[IgCL-TCRb-IAH-6MD]-F-P2A-SP-P SCA-Ha14-121-vH-[IgG1-CH1-TCRa-SDVP-6MD]-F-F2A-hNEMO-K277A | 3265 | 7178 |
| PSCA | CD8SP-PSCA-Ha14-117-vL-[IgCL-TCRb-IAH-6MD]-F-P2A-SP-P SCA-Ha14-117-vH-[IgG1-CH1-TCRa-SDVP-6MD]-F-F2A-hNEMO-K277A | 3266 | 7179 |
| PR1 | CD8SP-PR1-vL-[IgCL-TCRb-IAH-6MD]-F-P2A-SP-PR1-vH-[IgG1-CH1-TCRa-SDVP-6MD]-F-F2A-hNEMO-K277A | 3267 | 7180 |
| PSMA | CD8SP-PSMA-006-vL-[IgCL-TCRb-IAH-6MD]-F-P2A-SP-PSMA-006-vH-[IgG1-CH1-TCRa-SDVP-6MD]-F-F2A-hNEMO-K277A | 3268 | 7181 |
| PSMA | CD8SP-PSMA-J591-vL-[IgCL-TCRb-IAH-6MD]-F-P2A-SP-PSMA-J591-vH-[IgG1-CH1-TCRa-SDVP-6MD]-F-F2A-hNEMO-K277A | 3269 | 7182 |
| PTK7 | CD8SP-PTK7-hSC6-23-vL-[IgCL-TCRb-IAH-6MD]-F-P2A-SP-PTK7-hSC6-23-vH-[IgG1-CH1-TCRa-SDVP-6MD]-F-F2A-hNEMO-K277A | 3270 | 7183 |
| PTK7 | CD8SP-PTK7-SC6-10-2-vL-[IgCL-TCRb-IAH-6MD]-F-P2A-SP-PTK7-SC6-10-2-vH-[IgG1-CH1-TCRa-SDVP-6MD]-F-F2A-hNEMO-K277A | 3271 | 7184 |
| ROR1 | CD8SP-ROR1-4A5-vL-[IgCL-TCRb-IAH-6MD]-F-P2A-SP-ROR1-4A5-vH-[IgG1-CH1-TCRa-SDVP-6MD]-F-F2A-hNEMO-K277A | 3272 | 7185 |
| ROR1 | CD8SP-ROR1-4C10-vL-[IgCL-TCRb-IAH-6MD]-F- | 3273 | 7186 |

TABLE 14-continued

| | Ab-TCR CONSTRUCTS WITH DIFFERENT ANTIGEN BINDING DOMAINS. | | |
|---|---|---|---|
| Target | Name of CAR constructs including the name of antigen binding domain | SEQ ID NO (DNA) | SEQ ID NO (PRT) |
| | P2A-SP-ROR1-4C10-vH-[IgG1-CH1-TCRa-SDVP-6MD]-F-F2A-hNEMO-K277A | | |
| Mesothelin | CD8SP-SD1-[IgCL-TCRb-IAH-6MD]-F-P2A-SP-SD2-[IgG1-CH1-TCRa-SDVP-6MD]-F-F2A-hNEMO-K277A | 3274 | 7187 |
| SLea | CD8SP-SLea-7E3-vL-[IgCL-TCRb-IAH-6MD]-F-P2A-SP-SLea-7E3-vH-[IgG1-CH1-TCRa-SDVP-6MD]-F-F2A-hNEMO-K277A | 3275 | 7188 |
| SLea | CD8SP-SLea-5B1-vL-[IgCL-TCRb-IAH-6MD]-F-P2A-SP-SLea-5B1-vH-[IgG1-CH1-TCRa-SDVP-6MD]-F-F2A-hNEMO-K277A | 3276 | 7189 |
| SSEA4 | CD8SP-SSEA4-vL-[IgCL-TCRb-IAH-6MD]-F-P2A-SP-SSEA4-vH-[IgG1-CH1-TCRa-SDVP-6MD]-F-F2A-hNEMO-K277A | 3277 | 7190 |
| Tyrosinase | CD8SP-TA2-vL-[IgCL-TCRb-IAH-6MD]-F-P2A-SP-TA2-vH-[IgG1-CH1-TCRa-SDVP-6MD]-F-F2A-hNEMO-K277A | 3278 | 7191 |
| TCRB1 | CD8SP-TCRB1-CP01-E09-vL-[IgCL-TCRb-IAH-6MD]-F-P2A-SP-TCRB1-CP01-E09-vH-[IgG1-CH1-TCRa-SDVP-6MD]-F-F2A-hNEMO-K277A | 3279 | 7192 |
| TCRB1 | CD8SP-TCRB1-Jovi1-vL-[IgCL-TCRb-IAH-6MD]-F-P2A-SP-TCRB1-Jovi1-vH-[IgG1-CH1-TCRa-SDVP-6MD]-F-F2A-hNEMO-K277A | 3280 | 7193 |
| TCRB2 | CD8SP-TCRB2-CP01-D05-vL-[IgCL-TCRb-IAH-6MD]-F-P2A-SP-TCRB2-CP01-D05-vH-[IgG1-CH1-TCRa-SDVP-6MD]-F-F2A-hNEMO-K277A | 3281 | 7194 |
| TCRB2 | CD8SP-TCRB2-CP01-E05-vL-[IgCL-TCRb-IAH-6MD]-F-P2A-SP-TCRB2-CP01-E05-vH-[IgG1-CH1-TCRa-SDVP-6MD]-F-F2A-hNEMO-K277A | 3282 | 7195 |
| TCRgd | CD8SP-TCRgd-G5-4-vL-[IgCL-TCRb-IAH-6MD]-F-P2A-SP-TCRgd-G5-4-vH-[IgG1-CH1-TCRa-SDVP-6MD]-F-F2A-hNEMO-K277A | 3283 | 7196 |
| hTERT | CD8SP-TERT-4A9-T540-vL-[IgCL-TCRb-IAH-6MD]-F-P2A-SP-TERT-4A9-T540-vH-[IgG1-CH1-TCRa-SDVP-6MD]-F-F2A-hNEMO-K277A | 3284 | 7197 |
| hTERT | CD8SP-TERT-3G3-T865-vL-[IgCL-TCRb-IAH-6MD]-F-P2A-SP-TERT-3G3-T865-vH-[IgG1-CH1-TCRa-SDVP-6MD]-F-F2A-hNEMO-K277A | 3285 | 7198 |
| TGFBR2 | CD8SP-TGFBR2-Ab1-vL-[IgCL-TCRb-IAH-6MD]-F-P2A-SP-TGFBR2-Ab1-vH-[IgG1-CH1-TCRa-SDVP-6MD]-F-F2A-hNEMO-K277A | 3286 | 7199 |
| TIM1 | CD8SP-TIM1-HVCR1-270-2-vL-[IgCL-TCRb-IAH-6MD]-F-P2A-SP-TIM1-HVCR1-270-2-vH-[IgG1-CH1-TCRa-SDVP-6MD]-F-F2A-hNEMO-K277A | 3287 | 7200 |
| TIM1 | CD8SP-TIM1-HVCR1-ARD5-vL-[IgCL-TCRb-IAH-6MD]-F-P2A-SP-TIM1-HVCR1-ARD5vH-[IgG1-CH1-TCRa-SDVP-6MD]-F-F2A-hNEMO-K277A | 3288 | 7201 |
| TnAg | CD8SP-TnAg-vL-[IgCL-TCRb-IAH-6MD]-F-P2A-SP-TnAg-vH-[IgG1-CH1-TCRa-SDVP-6MD]-F-F2A-hNEMO-K277A | 3289 | 7202 |
| Tn-Muc1 | CD8SP-TnMuc1-hu5E5-RHA8-RKA-2-vL-[IgCL-TCRb-IAH-6MD]-F-P2A-SP-TnMuc1-hu5E5-RHA8-RKA-2vH-[IgG1-CH1-TCRa-SDVP-6MD]-F-F2A-hNEMO-K277A | 3290 | 7203 |
| TROP2 | CD8SP-TROP2-ARA47-HV3KV3-vL-[IgCL-TCRb-IAH-6MD]-F-P2A-SP-TROP2-ARA47-HV3KV3-vH-[IgG1-CH1-TCRa-SDVP-6MD]-F-F2A-hNEMO-K277A | 3291 | 7204 |
| TROP2 | CD8SP-TROP2-h7E6-SVG-vL-[IgCL-TCRb-IAH-6MD]-F-P2A-SP-TROP2-h7E6-S VG-vH-[IgG1-CH1-TCRa-SDVP-6MD]-F-F2A-hNEMO-K277A | 3292 | 7205 |
| TSHR | SP-TSHb-[IgCL-TCRb-IAH-6MD]-F-P2A-SP-CGHa-[IgG1-CH1-TCRa-SDVP-6MD]-F-F2A-hNEMO-K277A | 3293 | 7206 |
| TSHR | CD8SP-TSHR-K1-70-vL-[IgCL-TCRb-IAH-6MD]-F-P2A-SP-TSHR-K1-70-vH-[IgG1-CH1-TCRa-SDVP-6MD]-F-F2A-hNEMO-K277A | 3294 | 7207 |
| TSHR | CD8SP-TSHR-KB1-vL-[IgCL-TCRb-IAH-6MD]-F-P2A-SP-TSHR-KB1-vH-[IgG1-CH1-TCRa-SDVP-6MD]-F-F2A-hNEMO-K277A | 3295 | 7208 |
| TSHR | CD8SP-TSHR-5C9-vL-[IgCL-TCRb-IAH-6MD]-F-P2A-SP-TSHR-5C9-vH-[IgG1-CH1-TCRa-SDVP-6MD]-F-F2A-hNEMO-K277A | 3296 | 7209 |
| TSLPR | CD8SP-TSLPR-vL-[IgCL-TCRb-IAH-6MD]-F-P2A-SP-TSLPR-vH-[IgG1-CH1-TCRa-SDVP-6MD]-F- | 3297 | 7210 |

TABLE 14-continued

Ab-TCR CONSTRUCTS WITH DIFFERENT ANTIGEN BINDING DOMAINS.

| Target | Name of CAR constructs including the name of antigen binding domain | SEQ ID NO (DNA) | SEQ ID NO (PRT) |
|---|---|---|---|
| | F2A-hNEMO-K277A | | |
| Tyrosinase | CD8SP-Tyros-B2-vL-[IgCL-TCRb-IAH-6MD]-F-P2A-SP-Tyros-B2-vH-[IgG1-CH1-TCRa-SDVP-6MD]-F-F2A-hNEMO-K277A | 3298 | 7211 |
| Tyrosinase | CD8SP-Tyros-MC1-vL-[IgCL-TCRb-IAH-6MD]-F-P2A-SP-Tyros-MC1-vH-[IgG1-CH1-TCRa-SDVP-6MD]-F-F2A-hNEMO-K277A | 3299 | 7212 |
| Tyrosinase | CD8SP-Tyrosinase-B2-vL-[IgCL-TCRb-IAH-6MD]-F-P2A-SP-Tyrosinase-B2-vH-[IgG1-CH1-TCRa-SDVP-6MD]-F-F2A-hNEMO-K277A | 3300 | 7213 |
| VEGFR3 | CD8SP-VEGFR3-Ab1-vL-[IgCL-TCRb-IAH-6MD]-F-P2A-SP-VEGFR3-Ab1-vH-[IgG1-CH1-TCRa-SDVP-6MD]-F-F2A-hNEMO-K277A | 3301 | 7214 |
| WT1 | CD8SP-WT1-Ab1-vL-[IgCL-TCRb-IAH-6MD]-F-P2A-SP-WT1-Ab1-vH-[IgG1-CH1-TCRa-SDVP-6MD]-F-F2A-hNEMO-K277A | 3302 | 7215 |
| WT1 | CD8SP-WT1-Ab5-vL-[IgCL-TCRb-IAH-6MD]-F-P2A-SP-WT1-Ab5-vH-[IgG1-CH1-TCRa-SDVP-6MD]-F-F2A-hNEMO-K277A | 3303 | 7216 |
| WT1 | CD8SP-MYC3-WT1-Ab13-vL-[IgCL-TCRb-IAH-6MD]-F-P2A-SP-WT1-Ab13-vH-[IgG1-CH1-TCRa-SDVP-6MD]-F-F2A-hNEMO-K277A | 3304 | 7217 |
| WT1 | CD8SP-MYC3-WT1-Ab15-vL-[IgCL-TCRb-IAH-6MD]-F-P2A-SP-WT1-Ab15-vH-[IgG1-CH1-TCRa-SDVP-6MD]-F-F2A-hNEMO-K277A | 3305 | 7218 |
| CD123 | CD8SP-CD123-1172-vL-[IgCL-TCRb-IAH-6MD]-F-P2A-SP-CD123-1172-vH-[IgG1-CH1-TCRa-SDVP-6MD]-F-F2A-hNEMO-K277A | 3306 | 7219 |
| CDH19 | CD8SP-CDH19-4B10-vL-[IgCL-TCRb-IAH-6MD]-F-P2A-SP-CDH19-4B10-vH-[IgG1-CH1-TCRa-SDVP-6MD]-F-F2A-hNEMO-K277A | 3307 | 7220 |
| Folate Receptor beta | CD8SP-FRbeta-m923-vL-[IgCL-TCRb-IAH-6MD]-F-P2A-SP-FRbeta-m923-vH-[IgG1-CH1-TCRa-SDVP-6MD]-F-F2A-hNEMO-K277A | 3308 | 7221 |
| LHR | CD8SP-LHR-8B7-vL-[IgCL-TCRb-IAH-6MD]-F-P2A-SP-LHR-8B7-vH-[IgG1-CH1-TCRa-SDVP-6MD]-F-F2A-hNEMO-K277A | 3309 | 7222 |
| LHR | CD8SP-LHR-5F4-21-vL-[IgCL-TCRb-IAH-6MD]-F-P2A-SP-LHR-5F4-21-vH-[IgG1-CH1-TCRa-SDVP-6MD]-F-F2A-hNEMO-K277A | 3310 | 7223 |
| B7H4 | CD8SP-B7H4-hu22C10-vL-[IgCL-TCRb-IAH-6MD]-F-P2A-SP-B7H4-hu22C10-vH-[IgG1-CH1-TCRa-SDVP-6MD]-F-F2A-hNEMO-K277A | 3311 | 7224 |
| B7H4 | CD8SP-B7H4-hu1D11-vL-[IgCL-TCRb-IAH-6MD]-F-P2A-SP-B7H4-hu1D11-vH-[IgG1-CH1-TCRa-SDVP-6MD]-F-F2A-hNEMO-K277A | 3312 | 7225 |
| IgE | CD8SP-IgE-omalizumab-vL-[IgCL-TCRb-IAH-6MD]-F-P2A-SP-IgE-omalizumab-vH-[IgG1-CH1-TCRa-SDVP-6MD]-F-F2A-hNEMO-K277A | 3313 | 7226 |
| CD23 | CD8SP-CD23-p5E8-vL-[IgCL-TCRb-IAH-6MD]-F-P2A-SP-CD23-p5E8-vH-[IgG1-CH1-TCRa-SDVP-6MD]-F-F2A-hNEMO-K277A | 3314 | 7227 |
| GCC | CD8SP-GCC-5F9-vL-[IgCL-TCRb-IAH-6MD]-F-P2A-SP-GCC-5F9-vH-[IgG1-CH1-TCRa-SDVP-6MD]-F-F2A-hNEMO-K277A | 3315 | 7228 |
| GCC | CD8SP-GCC-Ab229-vL-[IgCL-TCRb-IAH-6MD]-F-P2A-SP-GCC-Ab229-vH-[IgG1-CH1-TCRa-SDVP-6MD]-F-F2A-hNEMO-K277A | 3316 | 7229 |
| CD200R | CD8SP-CD200R-huDx182-vL-[IgCL-TCRb-IAH-6MD]-F-P2A-SP-CD200R-huDx182-vH-[IgG1-CH1-TCRa-SDVP-6MD]-F-F2A-hNEMO-K277A | 3317 | 7230 |
| Tn-Muc1 | CD8SP-Tn-Muc1-5E5-vL-[IgCL-TCRb-IAH-6MD]-F-P2A-SP-Tn-Muc1-5E5-vH-[IgG1-CH1-TCRa-SDVP-6MD]-F-F2A-hNEMO-K277A | 3318 | 7231 |
| CD22 | CD8SP-CD22-5-vL-[IgCL-TCRb-IAH-6MD]-F-P2A-SP-CD22-5-vH-[IgG1-CH1-TCRa-SDVP-6MD]-F-F2A-hNEMO-K277A | 3319 | 7232 |
| CD22 | CD8SP-CD22-10-vL-[IgCL-TCRb-IAH-6MD]-F-P2A-SP-CD22-10-vH-[IgG1-CH1-TCRa-SDVP-6MD]-F-F2A-hNEMO-K277A | 3320 | 7233 |
| CD22 | CD8SP-CD22-31-vL-[IgCL-TCRb-IAH-6MD]-F-P2A-SP-CD22-31-vH-[IgG1-CH1-TCRa-SDVP-6MD]-F-F2A-hNEMO-K277A | 3321 | 7234 |
| CD22 | CD8SP-CD22-53-vL-[IgCL-TCRb-IAH-6MD]-F-P2A-SP-CD22-53-vH-[IgG1-CH1-TCRa-SDVP-6MD]-F- | 3322 | 7235 |

TABLE 14-continued

Ab-TCR CONSTRUCTS WITH DIFFERENT ANTIGEN BINDING DOMAINS.

| Target | Name of CAR constructs including the name of antigen binding domain | SEQ ID NO (DNA) | SEQ ID NO (PRT) |
|---|---|---|---|
| CD22 | F2A-hNEMO-K277A CD8SP-CD22-65-vL-[IgCL-TCRb-IAH-6MD]-F-P2A-SP-CD22-65-vH-[IgG1-CH1-TCRa-SDVP-6MD]-F-F2A-hNEMO-K277A | 3323 | 7236 |

In some embodiments, the compositions comprise nucleic acids encoding conventional CARs 1-6 (Table 1), wherein the antigen specific domain of the CAR targets one or more specific antigens as described in Tables 6A-C or Tables 5-6 in PCT/US2017/064379, which are incorporated herein by reference. In some embodiments, the compositions comprise nucleic acids encoding any one or more of backbones 1-72 (Table 2) where the antigen specific domain of the encoded CAR targets one or more specific antigens as described in in Tables 6A-C or Tables 5-6 in PCT/US2017/064379. In some embodiments, the compositions comprise nucleic acids encoding backbone-1, wherein the antigen specific domain of the CAR in backbone-1 targets one or more cancer specific antigens as described herein an in Tables 6A-C or Tables 5-6 of PCT/US2017/064379. In some embodiments, the compositions comprise nucleic acids encoding backbone-1, wherein the antigen specific domain of the CAR in backbone-2 targets one or more cancer specific antigens as described herein an in Tables 6A-C or Tables 5-6 of PCT/US2017/064379. In some embodiments, the compositions comprise nucleic acids encoding backbone-1, wherein the antigen specific domain of the CAR in backbone-37 targets one or more cancer specific antigens as described herein an in Tables 6A-C or Tables 5-6 of PCT/US2017/064379. In some embodiments, the compositions comprise nucleic acids encoding backbone-1, wherein the antigen specific domain of the CAR in backbone-38 targets one or more cancer specific antigens as described herein an in Tables 6A-C or Tables 5-6 of PCT/US2017/064379. In some embodiments, the compositions comprise nucleic acids encoding backbone-1, wherein the antigen specific domain of the CAR in backbone-49 targets one or more cancer specific antigens as described herein an in Tables 6A-C or Tables 5-6 of PCT/US2017/064379. In some embodiments, the compositions comprise nucleic acids encoding backbone-1, wherein the antigen specific domain of the CAR in backbone-50 targets one or more cancer specific antigens as described herein an in Tables 6A-C or Tables 5-6 of PCT/US2017/064379.

In various embodiments, the isolated nucleic acid molecules encoding the non-naturally occurring immune receptor, e.g, a CAR, components of the backbones described herein, encode one, two, three or more antigen specific domains. For example, one or more ASD that binds specifically to a cancer associated antigen as described herein can be used.

The sequences of the ASD are contiguous with and in the same reading frame as a nucleic acid sequence encoding the remainder of the one or more chains of CAR.

In one embodiment, each antigen specific region comprises the full-length IgG heavy chain (specific for the target antigen) having the $V_H$, CH1, hinge, and the CH2 and CH3 (Fc) Ig domains, if the $V_H$ domain alone is sufficient to confer antigen-specificity ("single-domain antibodies"). The full length IgG heavy chain may be linked to a co-stimulatory domain and an optional intracellular signaling domain via the appropriate transmembrane domain. If both, the $V_H$ and the $V_L$ domains, are necessary to generate a fully active antigen-specific targeting region, the $V_H$-containing non-naturally occurring immune receptor, e.g, a CAR, and the full-length lambda light chain (IgL) are both introduced into the cells to generate an active antigen-specific targeting region.

In some embodiments, the antigen specific domain of the encoded non-naturally occurring immune receptor, e.g, a CAR, molecule comprises an antibody, an antibody fragment, an scFv, a Fv, a Fab, a (Fab')$_2$, a single domain antibody (SDAB), a vH or vL domain, or a camelid vHH domain. In some embodiments, the antigen binding domain of the non-naturally occurring immune receptor, e.g, a CAR, is a scFv antibody fragment that is humanized compared to the murine sequence of the scFv from which it is derived.

In some instances, scFvs can be prepared according to methods known in the art (for example, Bird et al., (1988) Science 242:423-426 and Huston et al., (1988) Proc. Natl. Acad. Sci. USA 85:5879-5883). ScFv molecules can be produced by linking $V_H$ and $V_L$ regions together using flexible polypeptide linkers. The scFv molecules comprise a linker (e.g., a Ser-Gly linker) with an optimized length and/or amino acid composition (e.g., to optimize folding etc.). An scFv can comprise a linker of at least 1, 2, 3, 4, 5, 6, 7, 8, 9, 10, 11, 12, 13, 14, 15, 16, 17, 18, 19, 20, 25, 30, 35, 40, 45, 50, or more amino acid residues between its $V_L$ and $V_H$ regions. In some embodiments, the linker sequence comprises amino acids glycine and serine. In another embodiment, the linker sequence comprises sets of glycine and serine repeats. Variation in the linker length may retain or enhance activity, giving rise to superior efficacy in activity studies. In some embodiments, the antigen specific scFv antibody fragments are functional in that they bind the same antigen with the same or comparable affinity as the IgG antibody from which it is derived. In other embodiments, the antibody fragment has a lower binding affinity to the antigen compared to the antibody from which it is derived but is functional in that it provides a biological response described herein. In one embodiment, the CAR molecule comprises an antibody fragment that has a binding affinity $K_D$ of $10^{-4}$ M to $10^{-8}$ M, $10^{-5}$ M to $10^{-7}$ M, $10^{-6}$ M or $10^{-8}$ M, for the target antigen.

In one embodiment, the antigen specific domain comprises one, two or all three heavy chain (hc) CDRs, hcCDR1, hcCDR2 and hcCDR3 of an antibody or a scFv listed herein (Table 6B; SEQ ID NOs: 14122-15039), and/or one, two or all three light chain (lc) CDRs, lcCDR1, lcCDR2 and lcCDR3 of an antibody or a scFv listed herein (Tables 6A; SEQ ID NOs: 13204-14121) (also also see, Tables 5-6 of PCT/US2017/064379). In some embodiments, the ASD comprises a $V_L$ (or vL) fragment comprising all three light chain CDRs belonging to a specific scFv (Tables 6A; SEQ ID NOs: 13204-14121) or a $V_H$ (or vH) fragment comprising all three heavy chain CDRs belonging to a specific scFv (Table 6B; SEQ ID NOs: 14122-15039) (see also, Tables 5-6 of PCT/US2017/064379). Table 6C provides the names, target antigens and SEQ ID Nos of the different scFvs whose vL and vL fragments and CDRs are listed in Tables 6A and 6B. The vL and vH fragments and the corresponding scFvs can be used in various embodiments of the disclosure to constructs the CARs described herein.

In another embodiment, the antigen specific domain comprises a humanized antibody or an antibody fragment. In some aspects, a non-human antibody is humanized, where specific sequences or regions of the antibody are modified to increase similarity to an antibody naturally produced in a human or fragment thereof. In one aspect, the antigen binding domain is humanized. A humanized antibody can be produced using a variety of techniques known in the art, including but not limited to, CDR-grafting, veneering or resurfacing, and chain shuffling.

In a further embodiment, each antigen specific domain of the non-naturally occurring immune receptor, e.g, a CAR, may comprise a divalent (or bivalent) single-chain variable fragment (di-scFvs, bi-scFvs). In, for example, CARs comprising di-scFVs, two scFvs specific for each antigen are linked together by producing a single peptide chain with two $V_H$ and two $V_L$ regions, yielding tandem scFvs. (Xiong, Cheng-Yi; Natarajan, A; Shi, X B; Denardo, G L; Denardo, S J (2006). "Development of tumor targeting anti-MUC-1 multimer: effects of di-scFv unpaired cysteine location on PEGylation and tumor binding". Protein Engineering Design and Selection 19 (8): 359-367; Kufer, Peter; Lutterbüse, Ralf; Baeuerle, Patrick A. (2004). "A revival of bispecific antibodies". *Trends in Biotechnology* 22 (5): 238-244). CARs comprising at least two antigen-specific targeting regions would express two scFvs specific for each of the two antigens. The resulting ASD is joined to the co-stimulatory domain and the intracellular signaling domain via a hinge region and a transmembrane domain. Alternatively, non-naturally occurring immune receptor, e.g, a CAR, comprising two antigen specific targeting regions would express two vHH specific for each of the two antigens or two epitopes of the same antigen. Exemplary CARs targeting two antigens are represented by SEQ ID NOs: 1307 and 1310.

In another embodiment, each ASD of the non-naturally occurring immune receptor, e.g, a CAR, comprises a diabody. In a diabody, the scFvs are created with linker peptides that are too short for the two variable regions to fold together, driving the scFvs to dimerize. Still shorter linkers (one or two amino acids) lead to the formation of trimers, the so-called triabodies or tribodies. Tetrabodies may also be used.

In some embodiments, the ASD of the non-naturally occurring immune receptor, e.g, a CAR, comprises $V_{HH}$ fragments (nanobodies) as described herein (see, Tables 5-6 of PCT/US2017/064379). In some embodiments, the ASD of the non-naturally occurring immune receptor, e.g, a CAR, comprises affibodies as described herein (see, Tables 5-6 of PCT/US2017/064379).

In another embodiment, the antigen specific binding domain comprises a ligand for a cognate expressed on a target cell.

In one embodiment, an antigen specific domain of a non-naturally occurring immune receptor, e.g, a CAR, against a target antigen is an antigen binding portion, e.g., CDRs, of vHH fragments targeting this antigen (see, Tables 5-6 of PCT/US2017/064379).

In one embodiment, an antigen specific domain of a non-naturally occurring immune receptor, e.g, a CAR, against a target antigen is an antigen binding portion of a non-immunoglobulin scaffold targeting this antigen (see, Tables 5-6 of PCT/US2017/064379).

In one embodiment, an antigen specific domain of a non-naturally occurring immune receptor, e.g, a CAR, against a target antigen is an antigen binding portion of a receptor known to bind this target antigen (see, Tables 5-6 of PCT/US2017/064379).

In another aspect, the antigen binding domain is a T cell receptor ("TCR"), or a fragment thereof, for example, a single chain TCR (scTCR). Methods to make such TCRs are known in the art. See, e.g., Willemsen R A et al, Gene Therapy 7: 1369-1377 (2000); Zhang T et al, Cancer Gene Ther 11: 487-496 (2004); Aggen et al, Gene Ther. 19(4): 365-74 (2012) (references are incorporated herein by its entirety). For example, scTCR can be engineered that contain the Vα and vβ genes from a T cell clone linked by a linker (e.g., a flexible peptide). This approach is very useful to cancer associated target that itself is intracellular, however, a fragment of such antigen (peptide) is presented on the surface of the cancer cells by MHC.

In some embodiments, the antigen specific domain is a T cell receptor specific for the target antigen or a fragment of the T cell receptor, wherein the fragment retains the specificity for the target antigen.

In some embodiments, antigen specific domain of a non-naturally occurring immune receptor, e.g, a CAR, described herein binds to a MHC presented peptide. Normally, peptides derived from endogenous proteins fill the pockets of Major histocompatibility complex (MHC) class I molecules, and are recognized by T cell receptors (TCRs) on CD8+ T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigens in the context of human leukocyte antigen (HLA)-A1 or HLA-A2 have been described (see, e.g., Sastry et al., J Viral. 2011 85(5):1935-1942; Sergeeva et al., Blood, 2011117(16):4262-4272; Verma et al., Jlmmunol 2010 184(4):2156-2165; Willemsen et al., Gene Ther 20018(21):1601-1608; Dao et al., Sci Transl Med 2013 5(176):176ra33; Tassev et al., Cancer Gene Ther 2012 19(2):84-100). For example, TCR-like antibody can be identified from screening a library, such as a human scFv phage displayed library. Exemplary CARs that are based on TCR-like antibodies targeting WT1 in association with HLA-A2 are represented by SEQ ID NO: 1266 to SEQ ID NO: 1268. In the instant invention, CARs were generated using antigen binding domain derived from TCR like antibodies against several HLA-A2 restricted intracellular peptides. The target protein antigens, the peptide fragment and the sequence of the peptide are shown in Table 8.

In some embodiments, the antigens specific for disease which may be targeted by the non-naturally occurring immune receptor, e.g, a CAR, when expressed alone or with the accessory modules as described herein include but are not limited to any one or more of CDS; CD19; CD123; CD22; CD30; CD171; CS1 (also referred to as CD2 subset 1, CRACC, MPL, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac (2-3)bDGalp(1-4)bDG1cp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); sialyl Lewis adhesion molecule (sLe); ganglioside GM3 (aNeu5Ac(2-3)bD-Clalp(1-4)bDG1cp(1-1)Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRCSD); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; survivin; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin Bl; v-myc avian myelocytomatosis viral oncogene neuroblastoma derived homolog (MYCN); Ras Homolog Family Member C (RhoC); Tyrosinase-related protein 2 (TRP-2); Cytochrome P4501B 1 (CYP1B 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GM1, PTK7, gpNMB, CDH1-CD324, DLL3, CD276/B7H3, IL11Ra, IL13Ra2, CD179b-IGL11, TCRgamma-delta, NKG2D, CD32 (FCGR2A), Tn ag, Tim1–/HVCR1, CSF2RA (GM-CSFR-alpha), TGF-betaR2, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Gonadotropin Hormone receptor (CGHR or GR), CCR4, GD3, SLAMF6, SLAMF4, HIV1 envelope glycoprotein, HTLV1-Tax, CMV pp65, EBV-EBNA3c, KSHV K8.1, KSHV-gH, influenza A hemagglutinin (HA), GAD, PDL1, Guanylyl cyclase C (GCC), auto antibody to desmoglein 3 (Dsg3), auto antibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IgE, CD99, Ras G12V, Tissue Factor 1 (TF1), AFP, GPRCSD, Claudin18.2 (CLD18A2 or CLDN18A.2), P-glycoprotein, STEAP1, Livl, Nectin-4, Cripto, gpA33, BST1/CD157, low conductance chloride channel, and the antigen recognized by TNT antibody or combinations thereof.

In some embodiments, the antigens specific for a disease which may be targeted by the non-naturally occurring immune receptor, e.g, a CAR, when expressed alone or with the accessory modules as described herein include but are not limited to any one or more of 4-1BB, 5T4, adenocarcinoma antigen, alpha-fetoprotein, BAFF, B-lymphoma cell, C242 antigen, CA-125, carbonic anhydrase 9 (CA-IX), C-MET, CCR4, CD152, CD19, CD20, CD200, CD22, CD221, CD23 (IgE receptor), CD28, CD30 (TNFRSF8), CD33, CD4, CD40, CD44 v6, CD51, CD52, CD56, CD74, CD80, CD123, CEA, CNTO888, CTLA-4, DRS, EGFR, EpCAM, CD3, FAP, fibronectin extra domain-B, folate receptor 1, GD2, GD3 ganglioside, glycoprotein 75, GPNMB, HER2/neu, HGF, human scatter factor receptor kinase, IGF-1 receptor, IGF-I, IgG1, L1-CAM, IL-13, IL-6, insulin-like growth factor I receptor, integrin α5β1, integrin αvβ3, LAMP1, MORAb-009, MS4A1, MUC1, mucin CanAg, N-glycolylneuraminic acid, NPC-1C, PDGF-R α, PDL192, phosphatidylserine, prostatic carcinoma cells, RANKL, RON, ROR1, SCH 900105, SDC1, SLAMF7, TAG-72, tenascin C, TGF beta 2, TGF-β, TRAIL-R1, TRAIL-R2, tumor antigen CTAA16.88, VEGF-A, VEGFR-1, VEGFR2, vimentin or combinations thereof. Other antigens specific for cancer will be apparent to those of skill in the art and may be used in connection with alternate embodiments of the disclosure.

A CAR when used alone or with accessory modules as described herein can comprise an antigen binding domain (e.g., antibody or antibody fragment) that binds to a disease-supporting antigen (e.g., a disease-supporting antigen as described herein). In some embodiments, the disease-supporting antigen is an antigen present on cells that support the survival and proliferation of disease causing cells. In some embodiments, the disease-supporting antigen is an antigen present on a stromal cell or a myeloid-derived suppressor cell (MDSC). Stromal cells can secrete growth factors and cytokines to promote cell proliferation in the microenvironment. MDSC cells can block T cell proliferation and activation. Without wishing to be bound by theory, in some embodiments, the CAR-expressing cells destroy the disease-supporting cells, thereby indirectly blocking growth or survival of disease causing cells.

In certain embodiments, a stromal cell antigen is selected from one or more of: bone marrow stromal cell antigen 2 (BST2), fibroblast activation protein (FAP) and tenascin. In an embodiment, the FAP-specific antibody is, competes for binding with, or has the same CDRs as, sibrotuzumab. In embodiments, the MDSC antigen is selected from one or more of: CD33, CD11b, C14, CD15, and CD66b. Accordingly, in some embodiments, the disease supporting antigen is selected from one or more of: bone marrow stromal cell antigen 2 (BST2), fibroblast activation protein (FAP) or tenascin, CD33, CD11b, C14, CD15, and CD66b.

In another embodiment, the disclosure provides non-naturally occurring immune receptor, e.g, a CAR, that bind to the same epitope on different targets described in Tables 6A-C as any of the non-naturally occurring immune receptors of the disclosure (e.g., CARs that have the ability to cross-compete for binding to the different targets with any of the CARs of the disclosure). In some embodiments, the antigen specific domains of these non-naturally occurring immune receptors, e.g, a CARs, could be derived from vL fragments, vH fragments or scFv fragments of antibodies. In some embodiments, the reference antibodies for cross-competition studies to determine the target-epitope recognized by a non-naturally occurring immune receptor, e.g, a CAR, of the disclosure are scFvs described in Table 6C herein having sequences as shown in SEQ ID NOs: 4555-4815, 11165-11401, 15070-15132 (Table 6C) or as described in Tables 5-6 of PCT/US2017/064379. In an exemplary embodiment, the reference scFv FMC63(vL-vH) represented by SEQ ID NO: 4555 can be used in cross-competition studies to to determine the target-epitope recognized by FMC63-based conventional CARs and backbones of the disclosure. In some embodiments, the reference vHH fragments for cross-competition studies to determine the target-epitope recognized by a non-naturally occurring immune receptor, e.g, a CAR, of the disclosure described herein are vHH fragments having sequences as shown in SEQ ID NOs: 4474-4514. In some embodiments, the reference non-immunoglobulin antigen binding scaffolds for cross-competition studies for cross-competition studies to determine the target-epitope recognized by a non-naturally occurring immune receptor, e.g, a CAR, of the disclosure described herein are non-immunoglobulin antigen binding scaffolds having sequences as shown in SEQ ID NOs: 4515-4519. In some embodiments, the reference ligands for cross-competition studies to determine the target-epitope recognized by a CAR of the disclosure described herein are ligands having sequences whose SEQ ID Nos: 4544-4554. In some embodiments, the reference CARs for cross-competition studies against different targets are CARs whose SEQ IDs are shown in Tables 10-14.

In another embodiment, the reference antibodies for cross-competition studies to determine the target-epitopes recognized by the MPL-targeting CARs of the disclosure are antibodies mAb-1.6, mAb-1.111, mAb-1.75, mAb-1.78, mAb-1.169, and mAb-1.36 described in patent application US 2012/0269814 A1.

In another embodiment, the reference scFvs for cross-competition studies to determine the target-epitopes recognized by the MPL-targeting CARs of the disclosure are scFvs having sequences as shown in SEQ ID NOs: 4720-4727, in Table 6C or as described in Tables 5-6 of PCT/US2017/064379.

In another embodiment, the reference ligands for cross-competition studies to determine the target-epitopes recognized by the MPL-targeting CARs of the disclosure are TPO and mTPO ligands having sequences as listed in SEQ ID NOs: 4544-4545.

In another embodiment, the reference CARs for cross-competition studies to determine the target-epitopes recognized by the MPL-targeting CARs of the disclosure are CARs having sequences as shown in SEQ ID NOs: 5120-5126.

In the preferred embodiment, the MPL-targeting CARs of the disclosure bind to an epitope corresponding to the sequences shown in SEQ ID NO: 15160.

In one embodiment, the reference scFvs for cross-competition studies to determine the target-epitopes recognized by the CD19-targeting CARs of the invention are scFvs having sequences as shown in SEQ ID NOs: 4555-4568 and in Table 6C or as described in Tables 5-6 of PCT/US2017/064379. In another embodiment, the reference CARs for cross-competition studies to determine the target-epitopes recognized by the CD19-targeting CARs of the invention are CARs having sequences as shown in SEQ ID NOs: 4929-4943.

In one embodiment, the reference scFvs for cross-competition studies to determine the target-epitopes recognized by the CD20-targeting CARs of the invention are scFvs targeting CD20 and having SEQ IDs as listed in Table 6C or as described in Tables 5-6 of PCT/US2017/064379. In another embodiment, the reference CARs for cross-competition studies to determine the target-epitopes recognized by the CD20-targeting CARs of the invention are CARs targeting CD20 and having SEQ IDs as listed in Tables 12.

In the preferred embodiment, the CD20-targeting CARs of the disclosure bind to the epitopes corresponding to one or more of the sequences shown in SEQ ID NO: 15149-15154.

In one embodiment, the reference scFvs for cross-competition studies to determine the target-epitopes recognized by the BCMA-targeting CARs of the invention are scFvs targeting CD20 and having SEQ IDs as listed in Table 6C or as described in Tables 5-6 of PCT/US2017/064379. In another embodiment, the reference CARs for cross-competition studies to determine the target-epitopes recognized by the BCMA-targeting CARs of the invention are CARs targeting BCMA and having SEQ IDs as listed in Tables 12.

In the preferred embodiment, the BCMA-targeting CARs of the disclosure bind to the epitopes corresponding to one or more of the sequences shown in SEQ ID NO: 15155-15159.

In one embodiment, the reference scFvs for cross-competition studies against DLL3-targeting CARs of the invention are scFvs targeting DLL3 and having SEQ IDs as listed in Table 6C or as described in Tables 5-6 of PCT/US2017/064379. In another embodiment, the reference CARs for cross-competition studies against DLL3-targeting CARs of the invention are CARs targeting DLL3 and having SEQ IDs as listed in Table 12.

In one embodiment, the reference scFvs for cross-competition studies against LAMP1-targeting CARs of the invention are scFvs targeting LAMP1 and having SEQ IDs as listed in Table 6C or as described in Tables 5-6 of PCT/US2017/064379. In another embodiment, the reference CARs for cross-competition studies against LAMP1-targeting CARs of the invention are CARs targeting LAMP1 and having SEQ IDs as listed in Table 12.

In one embodiment, the reference scFvs for cross-competition studies against TROP2-targeting CARs of the invention are scFvs targeting TROP2 and having SEQ IDs as listed in Table 6C or as described in Tables 5-6 of PCT/US2017/064379. In another embodiment, the reference CARs for cross-competition studies against TROP2-targeting CARs of the invention are CARs targeting TROP2 and having SEQ IDs as listed in Table 12.

In one embodiment, the reference scFvs for cross-competition studies against PTK7-targeting CARs of the invention are scFvs targeting PTK7 and having SEQ IDs as listed in Table 6C or as described in Tables 5-6 of PCT/US2017/064379. In another embodiment, the reference CARs for cross-competition studies against PTK7-targeting CARs of the invention are CARs targeting PTK7 and having SEQ IDs as listed in Table 12.

In one embodiment, the reference scFvs for cross-competition studies against CD22, CD123, CD33, CD37, CD70, CD138, CS1, IL13Ra2, Folate Receptor α, Folate Receptor β, TCRB1, TCRB2, TCRγδ, CD30, Mesothelin, Her2, EGFRviii, and HIV1-targeting CARs of the invention are scFvs targeting these antigens and having SEQ IDs as listed in Table 6C or as described in Tables 5-6 of PCT/US2017/064379. In another embodiment, the reference CARs for cross-competition studies against CD22, CD123, CD33, CD37, CD70, CD138, CS1, IL13Ra2, Folate Receptor α, Folate Receptor β, TCRB1, TCRB2, TCRγδ, CD30, Mesothelin, Her2, EGFRviii, and HIV1-targeting CARs of the invention are CARs targeting these antigens and having SEQ IDs as listed in Table 12.

In some embodiments, the CARs described herein comprise a hinge or linker region between the antigen specific domain and the transmembrane domain. In some embodiments, the hinge region comprises any one or more of human CD8α or an Fc fragment of an antibody or a functional equivalent, fragment or derivative thereof, a hinge region of human CD8α or an antibody or a functional equivalent, fragment or derivative thereof, a CH2 region of an antibody, a CH3 region of an antibody, an artificial spacer sequence and combinations thereof. In exemplary embodiments, the hinge region comprises any one or more of (i) a hinge, CH2 and CH3 region of IgG4, (ii) a hinge region of IgG4, (iii) a hinge and CH2 region of IgG4, (iv) a hinge region of CD8α, (v) a hinge, CH2 and CH3 region of IgG1, (vi) a hinge region of IgG1, (vi) a hinge and CH2 region of IgG1, or (vii) combinations thereof.

In some embodiments, two or more functional domains of the non-naturally occurring immune receptors, e.g., CARs, as described herein, are separated by one or more linkers. Linkers are oligo- or polypeptides region from about 1 to 100 amino acids in length, that link together any of the domains/regions of the non-naturally occurring immune receptors, e.g., CARs, of the disclosure. In some embodiments, the linkers may be for example, 5-12 amino acids in length, 5-15 amino acids in length or 5-20 amino acids in length. Linkers may be composed of flexible residues like glycine and serine so that the adjacent protein domains are free to move relative to one another. Longer linkers, for example those longer than 100 amino acids, may be used in connection with alternate embodiments of the disclosure, and may be selected to, for example, ensure that two adjacent domains do not sterically interfere with one another.

As described herein, the CARs described herein comprise a transmembrane domain. The transmembrane domain may comprise the transmembrane sequence from any protein which has a transmembrane domain, including any of the type I, type II or type III transmembrane proteins. The transmembrane domain of the CAR of the disclosure may also comprise an artificial hydrophobic sequence. The transmembrane domains of the CARs described herein may be selected so that the transmembrane domain do not dimerize. In some embodiments, the CAR comprises any of the backbones described herein having a transmembrane domain selected from the transmembrane domain of an alpha, beta or zeta chain of a T-cell receptor, CD3ε, CD3ζ, CD3γ, CD3δ, CD28, CD45, CD4, CDS, CD8, CD9, CD16, CD22, CD33, CD37, CD64, CD80, CD86, CD134, CD137, CD154, KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), CD160, CD19, IL2R beta, IL2R gamma, IL7R a, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1(CD226), SLAMF4 (CD244, 2B4), CD84, CD96 (Tactile), CEACAM1, CRT AM, Ly9 (CD229), CD160 (BY55), PSGL1, CDIOO (SEMA4D), SLAMF6 (NTB-A, Ly108), SLAM (SLAMF1, CD150, IPO-3), BLAME (SLAMF8), SELPLG (CD162), LTBR, PAG/Cbp, NKp44, NKp30, NKp46, NKG2D, and/or NKG2C.

A transmembrane domain can include one or more additional amino acids (e.g., 1, 2, 3, 4, 5, 6, 7, 8, 9, 10 up to 15 amino acids) at either end of the transmembrane region (e.g., one or more amino acids extending extracellularly and/or one or more amino acids extending intracellularly) to the transmembrane region. In one aspect, the transmembrane domain is contiguous with one of the other domains of the CAR. In one embodiment, the transmembrane domain may be from the same protein that the signaling domain, costimulatory domain or the hinge domain is derived from. In another aspect, the transmembrane domain is not derived from the same protein that any other domain of the CAR is derived from.

In various embodiments, the isolated nucleic acid molecules encoding the non-naturally occurring immune receptors, e.g., CAR, components of the backbones described herein, encode zero, one, two, three or more intracellular signaling domain.

As described herein, the non-naturally occurring immune receptors, e.g., CARs, described herein can optionally comprise an intracellular signaling domain. This domain may be cytoplasmic and may transduce the effector function signal and direct the cell to perform its specialized function. Examples of intracellular signaling domains include, but are not limited to, ζ chain of the T-cell receptor or any of its homologs (e.g., η chain, CD3ε, CD3γ, CD3δ, FcεR1γ and β chains, MB1 (Igα) chain, B29 (Igβ) chain, etc.), CD3 polypeptides (Δ, δ and ε), syk family tyrosine kinases (Syk, ZAP 70, etc.), src family tyrosine kinases (Lck, Fyn, Lyn, etc.) and other molecules involved in T-cell transduction, such as CD2, CD5 and CD28. Specifically, the intracellular signaling domain may be human CD3 zeta chain, FcγRIII, FcεRI, cytoplasmic tails of Fc receptors, immunoreceptor tyrosine-based activation motif (ITAM) bearing cytoplasmic receptors or combinations thereof. Additional intracellular signaling domains will be apparent to those of skill in the art and may be used in connection with alternate embodiments of the invention. In some embodiments, the intracellular signaling domain comprises a signaling domain of one or more of a human CD3 zeta chain, FcgRIII, FceRI, a cyto-plasmic tail of a Fc receptor, an immunoreceptor tyrosine-based activation motif (ITAM) bearing cytoplasmic receptors, and combinations thereof.

In various embodiments, the isolated nucleic acid molecules encoding the non-naturally occurring immune receptor, e.g., CAR, components of the backbones described herein, encode zero, one, two, three or more co-stimulatory domains. In exemplary embodiments, the co-stimulatory domain comprises a signaling domain from any one or more of CD28, CD137 (4-1BB), CD134 (OX40), Dap10, CD27, CD2, CD5, ICAM-1, LFA-1, Lck, TNFR-I, TNFR-II, Fas, CD30, CD40 and combinations thereof. arious components of non-naturally occurring immune receptors, e.g., CARs, of the disclosure are provided above and elsewhere herein. Again it should be recognized that the disclosure provides, for example, CARs comprising an ecto-domain comprising an antigen specific binding domain attached via a 'hinge' of linker to a transmembrane domain, which is in-turn linked to an endo-domain comprising one or more stimulatory domains and optionally one or more intracellular signaling domains.

Provided herein are one or more polypeptides encoded by one or more nucleic acid molecules encoding conventional CARs 1 to 6 (Table 1) or any one or more of backbones 1-72 described herein (Table 2).

Also provided herein are one or more polypeptides encoded by one or more nucleic acid molecules encoding conventional CARs 1 to 6. In some embodiments, the antigen-specific domain of the CARs is specific to one, two, three or more antigens on target cells, such as cancer cells. As described herein, each component of the CAR is con-tiguous and in the same reading frame with each other components of the CAR. In some embodiments, in the CAR comprising backbone comprises more than one antigen specific domain, each of the antigen specific domains are contiguous and in the same reading frame as the other antigen specific domains in the same CAR.

Also provided herein are one or more polypeptides encoded by one or more nucleic acid molecules encoding backbones 1 to 10 comprising conventional CAR I and an accessory module encoding a NF-κB stimulatory molecule (e.g., vFLIP-K13, hNEMO-K277A, FKBPx2-hNEMO-K277A, FKBPx2-hNEMO-L753(251), FKBPx2-hNEMO-L600(200), FKBPx2-RIP-ID, IKK2-S177E-S181E, IKK1-S176E-S180E, MyD88-L265P, TCL-1A or their variants) as described herein. The accessory module in backbones 1-10 can be replaced by other accessory modules encoding dif-ferent molecules, including different NF-κB activators (e.g., K13-opt, hNEMO-K277A-delta-V249-K255 or hNEMO-K277L etc.). Also provided herein are one or more poly-peptides encoded by one or more nucleic acid molecules encoding backbones 11 to 12 comprising conventional CAR I and an accessory module encoding IgSP-[hTRAC-opt2]

and IgSP-[hTRBC-opt2]. In some embodiments, the anti-gen-specific domain of the CAR comprising backbones-1-12 is specific to one, two, three or more antigens on target cells, such as cancer cells. As described herein, each com-ponent of the CAR is contiguous and in the same reading frame with each other components of the CAR comprising backbones 1-12. In some embodiments, in the CAR com-prising backbones 1-12 comprises more than one antigen specific domain, each of the antigen specific domains are contiguous and in the same reading frame as the other antigen specific domains in the same CAR.

Also provided herein are one or more polypeptides encoded by one or more nucleic acid molecules encoding backbones 13 to 22 comprising conventional CAR II and an accessory module encoding a NF-κB stimulatory molecule (e.g., vFLIP-K13, hNEMO-K277A, FKBPx2-hNEMO-K277A, FKBPx2-hNEMO-L753(251), FKBPx2-hNEMO-L600(200), FKBPx2-RIP-ID, IKK2-S177E-S181E, IKK1-S176E-S180E, MyD88-L265P, TCL-1A or their variants) as described herein. The accessory module in backbones 13-22 can be replaced by other accessory modules encoding dif-ferent molecules, including different NF-κB activators (e.g., K13-opt, hNEMO-K277A-delta-V249-K255 or hNEMO-K277L etc.). In some embodiments, the antigen-specific domain of the CAR comprising backbones-13-22 is specific to one, two, three or more antigens on target cells, such as cancer cells. As described herein, each component of the CAR is contiguous and in the same reading frame with each other components of the CAR comprising backbones 13-24. In some embodiments, in the CAR comprising backbones 13-24 comprises more than one antigen specific domain, each of the antigen specific domains are contiguous and in the same reading frame as the other antigen specific domains in the same CAR.

Also provided herein are one or more polypeptides encoded by one or more nucleic acid molecules encoding backbones 37 to 46 comprising Ab-TCR and an accessory module encoding a NF-κB stimulatory molecule (e.g., vFLIP-K13, hNEMO-K277A, FKBPx2-hNEMO-K277A, FKBPx2-hNEMO-L753(251), FKBPx2-hNEMO-L600 (200), FKBPx2-RIP-ID, IKK2-S177E-S181E, IKK1-S176E-S180E, MyD88-L265P, TCL-1A or their variants) as described herein. The accessory module in backbones 37 to 46 can be replaced by other accessory modules encoding different molecules, including different NF-κB activators (e.g., K13-opt, hNEMO-K277A-delta-V249-K255 or hNEMO-K277L etc.).

Also provided herein are one or more polypeptides encoded by one or more nucleic acid molecules encoding backbones 49 to 58 comprising double chain cTCR/SIR and an accessory module encoding a NF-κB stimulatory mol-ecule (e.g., vFLIP-K13, hNEMO-K277A, FKBPx2-hNEMO-K277A, FKBPx2-hNEMO-L753(251), FKBPx2-hNEMO-L600(200), FKBPx2-RIP-ID, IKK2-S177E-S181E, IKK1-S176E-S180E, MyD88-L265P, TCL-1A or their variants) as described herein. The accessory module in backbones 49 to 58 can be replaced by other accessory modules encoding different molecules, including different NF-κB activators (e.g., K13-opt, hNEMO-K277A-delta-V249-K255 or hNEMO-K277L etc.).

Also provided herein are one or more polypeptides encoded by one or more nucleic acid molecules encoding backbones 61 to 70 comprising one-and-a-half chain (OHC) cTCR/SIR and an accessory module encoding a NF-κB stimulatory molecule (e.g., vFLIP-K13, hNEMO-K277A, FKBPx2-hNEMO-K277A, FKBPx2-hNEMO-L753(251), FKBPx2-hNEMO-L600(200), FKBPx2-RIP-ID, IKK2-

S177E-S181E, IKK1-S176E-S180E, MyD88-L265P, TCL-1A or their variants) as described herein. The accessory module in backbones 61 to 70 can be replaced by other accessory modules encoding different molecules, including different selective NF-κB activators (e.g., K13-opt, hNEMO-K277A-delta-V249-K255 or hNEMO-K277L etc.).

In various embodiments, the polypeptides encoded by the nucleic acid molecules encoding CARs which are part of the backbones described herein, such as backbone-1, backbone-2, backbone-13, backbone-14, backbone-37, backbone-38, backbone-49, backbone-50, backbone-60 or backbone-61, comprise one, two, three or more NF-κB stimulatory molecule (e.g., K13-vFLIP, K13opt, NEMO, NEMO K277A, human NEMO-K277L, human NEMO-K277A-DeltaV249-K255, or mouse NEMO K270A or their variants).

In some embodiments, provided herein are polypeptides encoded by the nucleic acid molecules encoding CARs which are part of the conventional CARs 1 to 6 or are part of the backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to the thrombopoietin receptor, MPL. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD19. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD20. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD22. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD23 In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD30. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD32. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD33. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD123. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD138. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD200R. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD276. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD324. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to BCMA. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CS1. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to ALK1. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to ROR1. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CDH6 In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CDH16. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CDH17. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CDH19. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to EGFRviii. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to Her2. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to Her3. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to Mesothelin. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to Folate Receptor alpha. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to Folate Receptor beta. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CLL-1. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CLEC5A. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to NY-ESO/MHC class I complex. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to WT1/MHC class I complex. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to WT1/MHC class I complex. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to AFP/MHC class I complex. In some embodiments, provided herein are polypeptides encoded by the nucleic acid molecules encoding CARs which are part of the conventional CARs 1 to 6 or are part of backbones described herein, such as backbone-13, backbone-14, backbone-37, backbone-38, backbone-49, backbone-50, backbone-60 or backbone-61, wherein the antigen-specific domain of the CARs is specific to HPV16-E7/MHC class I complex. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to gp100/MHC class I complex. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to hTERT/MHC class I complex. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to MART1/MHC class I complex. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to HTLV1-Tax/MHC class I complex. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to PR1/MHC class I complex. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to HIV1-gag/MHC class I complex. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to HIV1-envelop gp120. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to DLL3. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbonebone-38, backbone-49, backbone-50, backbone-60 or backbone-61, wherein the antigen-specific domain of the CARs is specific to PTK7. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to TROP2. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to LAMP1. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to Timl. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to TCR gamma-delta. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to TCR beta1 constant chain. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to TCR beta2 constant chain. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to GCC. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to B7H4. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to LHR. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to TSHR. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to Tn-Muc1. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to TSLPR. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to Tissue Factor. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to SSEA-4. In some embodiments, provided herein are polypeptides encoded by the nucleic acid molecules encoding CARs which are part of the conventional CARs 1 to 6 or are part of backbones described herein, such as backbone-1, backbone-2, backbone-32 or backbone-33, wherein the antigen-specific domain of the CARs is specific to SLea. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to Muc1/MHC class I complex. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to Muc16. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to NYBR-1. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to IL13Ra2. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to IL11Ra. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to L1CAM. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to EpCAM1. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to gpNMB. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to GRP78. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to GPC3. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to GRPC5D. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to GFRa4. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to FITC. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD79b. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to Lyml. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to Lym2. In some embodiments, provided herein are polypeptides encoded by the nucleic acid molecules encoding CARs which are part of the conventional CARs 1 to 4 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CLD18A2. In some embodiments, provided herein are polypeptides encoded by the nucleic acid molecules encoding CARs which are part of the conventional CARs 1 to 4 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD43 epitope expressed on leukemia cells. In some embodiments, provided herein are polypeptides encoded by the nucleic acid molecules encoding CARs which are part of the conventional CARs 1 to 4 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to CD179a. In some embodiments, provided herein are polypeptides encoded by the nucleic acid molecules encoding CARs which are part of the conventional CARs 1 to 6 or are part of backbones described herein, such as backbone-1, backbone-2, backbone-13, backbone-14, backbone-37, backbone-38, backbone-49, backbone-50, backbone-60 or backbone-61, wherein the antigen-specific domain of the CARs is specific to Fc portion of an antibody (i.e. Ig Fc). An exemplary CAR with the antigen-specific domain specific to Ig Fc is represented by SEQ ID NO: 1629 and contains the extracellular domain of CD16-V158 as the antigen specific domain. In any of the foregoing, the nucleic acid molecule encoding the CAR construct further comprise a NF-κB activator coding sequence, or alternatively, a NF-κB activator coding sequence can be present on a second nucleic acid molecule.

The nucleic acid sequences encoding for the desired components of the non-naturally occurring immune receptors, e.g., CARs, and/or a selective NF-κB activator coding sequence described herein can be obtained using recombinant methods known in the art, such as, for example by screening libraries from cells expressing the nucleic acid molecule, by deriving the nucleic acid molecule from a vector known to include the same, or by isolating directly from cells and tissues containing the same, using standard techniques. Alternatively, the nucleic acid of interest can be produced synthetically, rather than cloned.

In some embodiments, the nucleic acid molecule encoding the non-naturally occurring immune receptors, e.g., CARs, and/or accessory molecules (e.g., a NF-κB activator sequence) described herein is provided as a messenger RNA (mRNA) transcript. In another embodiment, the nucleic acid molecule encoding the non-naturally occurring immune receptors, e.g., CARs, and/or accessory molecules (e.g., a selective NF-κB activator coding sequence) described herein is provided as a DNA construct.

Cloning and expression methods will be apparent to a person of skill in the art and may be as described in WO 2015/142675; Sambrook et al., 2012, MOLECULAR CLONING: A LABORATORY MANUAL, volumes 1-4, Cold Spring Harbor Press, N.Y.; June et al. 2009 Nature Reviews Immunology 9.10: 704-716; WO 01/96584; WO 01/29058; U.S. Pat. No. 6,326,193, the contents of each of which are herein incorporated by reference in their entirety as though set forth herein. Physical methods for introducing polynucleotides of into host cells such as calcium phosphate transfection and the like are well known in the art and will be apparent to a person of skill in the art. In exemplary embodiments, such methods are set forth in Sambrook et al., 2012, MOLECULAR CLONING: A LABORATORY MANUAL, volumes 1-4, Cold Spring Harbor Press, NY); U.S. Pat. Nos. 5,350,674 and 5,585,362, the contents of each of which are herein incorporated by reference in their entirety as though set forth herein. In another embodiment, a CAR vector is transduced into a cell, e.g., a T cell or a NK cell, by causing transient perturbations in cell membrane using a microfluid device as described in patent application WO 2013/059343 A1 (PCT/US2012/060646) and in Ding X et al, Nat. Biomed. Eng. 1, 0039 (2017) the contents of each of which are herein incorporated by reference in their entirety as though set forth herein.

The disclosure provides a recombinant nucleic acid construct comprising a nucleic acid molecule encoding a non-naturally occurring immune receptor, e.g., CAR, wherein the nucleic acid molecule comprises a nucleic acid sequence encoding one or more antigen binding domains, wherein the nucleotide sequences encoding each of the antigen binding domains are contiguous with and in the same reading frame as the nucleic acid sequences encoding a: (i) optional hinge/linker, (ii) transmembrane domain, and (iii) optional intracellular domain, or (a) a T cell receptor constant chain. An exemplary T cell receptor constant chain that can be used in the construction of SIR includes, but is not limited to, constant chain of TCRα, TCRβ1, TCRβ2, TCRγ, TCRγ, preTCRα and variants and mutants thereof. In some embodiments, a NF-κB activator (e.g., a selective NF-κB activator) coding sequence is on the same recombinant nucleic acid construct but upon expression is not linked to the non-naturally occurring immune receptor, e.g., CAR, but is rather cleaved off (e.g., via a peptide cleavable linker) or is part of its own expression cassette in the polynucleotide.

The disclosure also provides a vector or vectors comprising a nucleic acid sequence or sequences encoding a non-naturally occurring immune receptor, e.g., CAR, described herein and an accessory module. In some embodiments, the accessory module encodes a NF-κB activator, e.g., a selective NF-κB activator. In some embodiment, the selective NF-κB activator is a non-naturally occurring NF-κB activator. In one embodiment, the non-naturally occurring immune receptor, e.g., CAR, and the accessory module, e.g., an accessory module encoding a NF-κB activator, are encoded by a single vector. In another embodiment, the non-naturally occurring immune receptor, e.g., CAR, and the accessory module, e.g., an accessory module encoding a NF-κB activator, are encoded by more than one vector. In yet another embodiment, a non-naturally occurring immune receptor, e.g., CAR, and the accessory module, e.g., an accessory module encoding a NF-κB activator, are each encoded by a separate vector or by separate nucleic acids. In one embodiment, the two functional polypeptide units (e.g, CAR and accessory module) are encoded by a single vector or a single nucleic acid. In one embodiment, the vector or the vectors are chosen from DNA vector(s), RNA vector(s), plasmid(s), lentivirus vector(s), adenoviral vector(s), retrovirus vector(s), baculovirus vector(s), sleeping beauty transposon vector(s), or a piggyback transposon(s). In one embodiment, the vector is a lentivirus vector or a retroviral vector. In another embodiment, the vector is a sleeping beauty transposon vector. The nucleic acid sequences of exemplary vectors are provided in SEQ ID NO: 3840-3841. The vectors pLenti-EF1α (SEQ ID NO: 3840) and pLenti-EF1α-DWPRE (SEQ ID NO: 3841) are empty lentiviral vectors that differ by the fact that pLenti-EF1α-DWPRE lacks the WPRE region. The nucleic acid sequence of pCCL3-MNDU3-WPRE vector is given in SEQ ID NO: 7779. A non-naturally occurring immune receptor coding sequence of the disclosure can be cloned between the Nhe I and Sal I sites in these vectors.

A retroviral vector may also be, e.g., a gammaretroviral vector. A gammaretroviral vector may include, e.g., a promoter, a packaging signal (ψ), a primer binding site (PBS), one or more (e.g., two) long terminal repeats (LTR), and a transgene of interest, e.g., a gene encoding a non-naturally occurring immune receptor, e.g., CAR. A gammaretroviral vector may lack viral structural gens such as gag, pol, and env. Exemplary gammaretroviral vectors include Murine Leukemia Virus (MLV), Spleen-Focus Forming Virus (SFFV), and Myeloproliferative Sarcoma Virus (MPSV), and vectors derived therefrom. Other gammaretroviral vectors are described, e.g., in Tobias Maetzig et al., "Gammaretroviral Vectors: Biology, Technology and Application" Viruses. 2011 Jun. 3 (6): 677-713. In another embodiment, the vector comprising the nucleic acid encoding the desired non-naturally occurring immune receptors of the disclosure is an adenoviral vector (A5/35).

In some embodiments, a vector of the disclosure can further comprise a promoter. Non-limiting examples of a promoter include, for example, a MNDU3 promoter, a CMV IE gene promoter, an EF-la promoter, an ubiquitin C promoter, a core-promoter or a phosphoglycerate kinase (PGK) promoter. In some embodiments, the promoter is an EF-1 promoter. In some embodiments, the vector comprises a poly(A) tail. In some embodiments, the vector comprises a 3'UTR.

The disclosure also includes an RNA construct that can be directly transfected into a cell. A method for generating mRNA for use in transfection involves in vitro transcription (IVT) of a template with specially designed primers, followed by poly A addition, to produce a construct containing 3' and 5' untranslated sequence ("UTR") (e.g., a 3' and/or 5' UTR described herein), a 5' cap (e.g., a 5' cap described herein) and/or Internal Ribosome Entry Site (IRES) (e.g., an IRES described herein), the nucleic acid to be expressed, and a poly A tail, typically 50-2000 bases in length (SEQ ID NO:3855). RNA so produced can efficiently transfect different kinds of cells. In one embodiment, the template includes sequences for the non-naturally occurring immune receptor, e.g., CAR, and/or the NF-κB stimulatory molecule. In one embodiment, an RNA CAR-NFκB vector is transduced into a cell, e.g., a T cell or a NK cell, by electroporation. In another embodiment, an RNA CAR vector and/or a NF-κB activator vector is transduced into a cell, e.g., a T cell or a NK cell, by causing transient perturbations in cell membrane using a microfluid device. The different chains (or functional polypeptide units) can be also introduced in a cell using one or more than one vector a combination of different vectors or techniques. In another embodiment, a non-naturally occurring immune receptor, e.g., CAR, can be introduced using a retroviral vector while the accessory module encoding a NF-κB activator is introduced using a lentiviral vector. In another aspect, a non-naturally occurring immune receptor, e.g., CAR, is introduced using a lentiviral vector while the accessory module (e.g., a NF-κB activator) is introduced using a sleeping beauty transposon. In yet another aspect, a non-naturally occurring immune receptor, e.g., CAR, is introduced using a lentiviral vector while the accessory module (e.g., a NF-κB activator) is introduced using a RNA transfection. In yet another aspect, a non-naturally occurring immune receptor, e.g., CAR, is produced in a cell by genetic recombination at the endogeneous TCR chain loci using gene targeting techniques known in the art while the accessory module is introduced using a lentiviral or a retroviral vector.

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001) or by causing transient perturbations in cell membranes using a microfluidic device (see, for example, patent applications WO 2013/059343 A1 and PCT/US2012/060646).

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

Exemplary methods of nucleic acid delivery using a transposon include a Sleeping Beauty transposon system (SBTS) and a piggyBac (PB) transposon system. See, e.g., Aronovich et al. Hum. Mol. Genet. 20. R1(2011):R14-20; Singh et al. Cancer Res. 15(2008):2961-2971; Huang et al. Mol. Ther. 16(2008):580-589; Grabundzija et al. Mol. Ther. 18(2010):1200-1209; Kebriaei et al. Blood. 122.21(2013): 166; Williams. Molecular Therapy 16.9(2008): 1515-16;

Bell et al. Nat. Protoc. 2.12(2007):3153-65; and Ding et al. Cell. 122.3(2005):473-83, all of which are incorporated herein by reference.

The SBTS includes two components: 1) a transposon containing a transgene and 2) a source of transposase enzyme. The transposase can transpose the transposon from a carrier plasmid (or other donor DNA) to a target DNA, such as a host cell chromosome/genome. For example, the transposase binds to the carrier plasmid/donor DNA, cuts the transposon (including transgene(s)) out of the plasmid, and inserts it into the genome of the host cell. See, e.g., Aronovich et al. supra.

Exemplary transposons include a pT2-based transposon. See, e.g., Grabundzija et al. Nucleic Acids Res. 41.3(2013): 1829-47; and Singh et al. Cancer Res. 68.8(2008): 2961-2971, all of which are incorporated herein by reference. Exemplary transposases include a Tc 1/mariner-type transposase, e.g., the SB 10 transposase or the SB 11 transposase (a hyperactive transposase which can be expressed, e.g., from a cytomegalovirus promoter). See, e.g., Aronovich et al.; Kebriaei et al.; and Grabundzija et al., all of which are incorporated herein by reference.

Use of the SBTS permits efficient integration and expression of a transgene, e.g., a nucleic acid encoding a CAR and/or a NF-κB activator described herein. Provided herein are methods of generating a cell, e.g., T cell or NKT cell or stem cell or iPSC or synthetic T cell, that stably expresses a CAR and/or a NF-κB activator described herein, e.g., using a transposon system such as SBTS.

In accordance with methods described herein, in some embodiments, one or more nucleic acids, e.g., plasmids, containing the SBTS components are delivered to a cell (e.g., T or NKT cell or stem cell or iPSC or synthetic T cell). For example, the nucleic acid(s) are delivered by standard methods of nucleic acid (e.g., plasmid DNA) delivery, e.g., methods described herein, e.g., electroporation, transfection, or lipofection. In some embodiments, the nucleic acid contains a transposon comprising a transgene, e.g., a nucleic acid encoding a non-naturally occurring immune receptor, e.g., CAR, and/or a NF-κB activator described herein. In some embodiments, the nucleic acid contains a transposon comprising a transgene (e.g., a nucleic acid encoding a non-naturally occurring immune receptor, e.g., CAR, and/or a NF-κB activator described herein) as well as a nucleic acid sequence encoding a transposase enzyme. In other embodiments, a system with two nucleic acids is provided, e.g., a dual-plasmid system, e.g., where a first plasmid contains a transposon comprising a transgene, and a second plasmid contains a nucleic acid sequence encoding a transposase enzyme. For example, the first and the second nucleic acids are codelivered into a host cell.

As described above and elsewhere herein, the disclosure demonstrates that co-expression of an immune receptor (e.g, a CAR, an endogenous TCR or a recombinant TCR) of the disclosure with an NF-κB stimulatory molecule (e.g., a selective NF-κB activator, e.g., a non-naturally occurring NF-κB activating agent, e.g., hNEMO-K277A) improves the functions of immune cells such as survival, expansion, proliferation, activation, persistence, cytokine production and in vivo activity. In some embodiments, the immune receptor is a non-naturally occurring immune receptor (e.g., CAR or recombinant TCR). In some embodiments, the immune receptor is a naturally occurring immune receptor (e.g., a native TCR). In one embodiment, an NF-κB stimulatory molecule is co-expressed with a first generation, second generation, third generation CAR, TFP, AbTCR, or SIR. As mentioned above, the NF-κB stimulatory molecule can be, but preferably is not, linked to a CAR, TCR or SIR backbone. Moreover, in certain embodiments, a CAR of the disclosure does not include a CD28 or 41BB domain, and optionally includes a CD3 domain.

In one embodiment, the disclosure demonstrates that expression of a selective NF-κB activator improves the functions of immune cells (e.g., T cells, dendritic cells, CAR-T cells or TCR-T cells etc.) such as survival, expansion, proliferation, activation, persistence, cytokine production and in vivo activity. A selective NF-κB activator as described herein, refers to an agent that activates the NF-κB signaling pathway selectively with no or minimal activation of the other signaling pathways. In one embodiment, a selective NF-κB activator activates NF-κB signaling pathway with no or minimal activation of one or more of signaling pathways selected from the group of AKT, PI3K, JNK, p38 kinase, ERK, JAK/STAT and interferon signaling pathways. A number of methods to measure the activation of the NF-κB, AKT, PI3K, JNK, p38 kinase, ERK, JAK/STAT and interferon signaling pathways are known in the art. These assays can be used in the methods of the disclosure either singly or in combinations to identify selective activators of NF-κB pathway.

In one embodiment, a selective NF-κB activator induces more than 20% (e.g., more than 30%, 40%, 50%, 60%, 70%, 80%, 90%, 100%) increase in NF-κB activity as measured by Phospho-NF-κB p65 (Ser536) antibody (Cell Signaling Technology; Danvers, MA) but less than 20% increase in the activity of the AKT pathway as measured using Phospho-Akt (Ser473) antibody (Cell Signaling Technology; Danvers, MA) when exposed to or expressed in a test human T cell as compared to a control human T cell. In some embodiments, a selective NF-κB activator induces more than 20% (e.g., more than 30%, 40%, 50%, 60%, 70%, 80%, 90%, 100%) increase in NF-κB activity as measured by Phospho-NF-κB p65 (Ser536) antibody (Cell Signaling Technology; Danvers, MA) but less than 20% increase in the activity of the JNK pathway as measured using Phospho-SAPK/JNK (Thr183/Tyr185) antibody (e.g., clone G9; Cell Signaling Technology; Danvers, MA) when exposed to or expressed in a test human T cell as compared to a control human T cell. In some embodiments, a selective NF-κB activator induces more than 20% (e.g., more than 30%, 40%, 50%, 60%, 70%, 80%, 90%, 100%) increase in NF-κB activity as measured by Phospho-NF-κB p65 (Ser536) antibody (Cell Signaling Technology; Danvers, MA) but less than 20% increase in the activity of the p38 kinase pathway as measured using Phospho-p38 MAPK (Thr180/Tyr182) antibody (e.g., clone D3F9; Cell Signaling Technology; Danvers, MA) when exposed to or expressed in a test human T cell as compared to a control human T cell. In some embodiments, a selective NF-κB activator induces more than 20% (e.g., more than 30%, 40%, 50%, 60%, 70%, 80%, 90%, 100%) increase in NF-κB activity as measured by Phospho-NF-κB p65 (Ser536) antibody (Cell Signaling Technology; Danvers, MA) but less than 20% increase in the activity of the STAT pathway as measured using Phospho-Stat1 (Tyr701) antibody (e.g., Clone D4A7; Cell Signaling Technology; Danvers, MA) when exposed to or expressed in a test human T cell as compared to a control human T cell. In some embodiments, a selective NF-κB activator induces more than 20% (e.g., more than 30%, 40%, 50%, 60%, 70%, 80%, 90%, 100%) increase in NF-κB activity as measured by Phospho-NF-κB p65 (Ser536) antibody (Cell Signaling Technology; Danvers, MA) but less than 20% increase in the activity of the STAT pathway as measured using Phospho-Stat2 (Tyr690) antibody (Cell Signaling Technology; Danvers, MA) when exposed to or expressed in a test human T cell as compared to a control human T cell. In some embodiments, a selective NF-κB activator induces more than 20% (e.g., more than 30%, 40%, 50%, 60%, 70%, 80%, 90%, 100%) increase in NF-κB activity as measured by Phospho-NF-κB p65 (Ser536) antibody (Cell Signaling Technology; Danvers, MA) but less than 20% increase in the activity of the STAT pathway as measured using Phospho-Stat3 (Tyr705) antibody (e.g., Clone D3A7, Cell Signaling Technology; Danvers, MA) when exposed to or expressed in a test human T cell as compared to a control human T cell. In some embodiments, a selective NF-κB activator induces more than 20% (e.g., more than 30%, 40%, 50%, 60%, 70%, 80%, 90%, 100%) increase in NF-κB activity as measured by Phospho-NF-κB p65 (Ser536) antibody (Cell Signaling Technology; Danvers, MA) but less than 20% increase in the activity of the STAT pathway as measured using Phospho-Stat5 (Tyr694) antibody (e.g., Clone D47E7, Cell Signaling Technology; Danvers, MA) when exposed to or expressed in a test human T cell as compared to a control human T cell. In some embodiments, a selective NF-κB activator induces more than 20% (e.g., more than 30%, 40%, 50%, 60%, 70%, 80%, 90%, 100%) increase in NF-κB activity as measured by Phospho-NF-κB p65 (Ser536) antibody (Cell Signaling Technology; Danvers, MA) but less than 20% increase in the activity of the ERK pathway as measured using Phospho-p44/42 MAPK (Erk1/2) (Thr202/Tyr204) (e.g., Clone D13.14.4E, Cell Signaling Technology; Danvers, MA) when exposed to or expressed in a test human T cell as compared to a control human T cell.

In one embodiment, a selective NF-κB activator induces more than 20% (e.g., more than 30%, 40%, 50%, 60%, 70%, 80%, 90%, 100%) increase in NF-κB activity as measured by Phospho-IκBα (Ser32) antibody (e.g., 14D4, Clone Cell Signaling Technology; Danvers, MA) subunit but less than 20% increase in the activity of the AKT pathway as measured using Phospho-Akt (Ser473) antibody (Cell Signaling Technology; Danvers, MA) when exposed to or expressed in a test human T cell as compared to a control human T cell.

In some embodiments, a selective NF-κB activator induces more than 20% (e.g., more than 30%, 40%, 50%, 60%, 70%, 80%, 90%, 100%) increase in NF-κB activity as measured by Phospho-IκBα (Ser32) antibody (e.g., 14D4, Clone Cell Signaling Technology; Danvers, MA) but less than 20% increase in the activity of the JNK pathway as measured using Phospho-SAPK/JNK (Thr183/Tyr185) antibody (e.g., clone G9; Cell Signaling Technology; Danvers, MA) when exposed to or expressed in a test human T cell as compared to a control human T cell. In some embodiments, a selective NF-κB activator induces more than 20% (e.g., more than 30%, 40%, 50%, 60%, 70%, 80%, 90%, 100%) increase in NF-κB activity as measured by Phospho-IκBα (Ser32) antibody (e.g., 14D4, Clone Cell Signaling Technology; Danvers, MA) but less than 20% increase in the activity of the p38 kinase pathway as measured using Phospho-p38 MAPK (Thr180/Tyr182) antibody (e.g., clone D3F9; Cell Signaling Technology; Danvers, MA) when exposed to or expressed in a test human T cell as compared to a control human T cell. In some embodiments, a selective NF-κB activator induces more than 20% (e.g., more than 30%, 40%, 50%, 60%, 70%, 80%, 90%, 100%) increase in NF-κB activity as measured by Phospho-IκBα (Ser32) antibody (e.g., 14D4, Clone Cell Signaling Technology; Danvers, MA) but less than 20% increase in the activity of the STAT pathway as measured using Phospho-Stat1 (Tyr701) antibody (e.g., Clone D4A7; Cell Signaling Technology; Danvers, MA) when exposed to or expressed in a test human T cell as compared to a control human T cell. In some embodiments, a selective NF-κB activator induces more than 20% (e.g., more than 30%, 40%, 50%, 60%, 70%, 80%, 90%, 100%) increase in NF-κB activity as measured by Phospho-IκBα (Ser32) antibody (e.g., 14D4, Clone Cell Signaling Technology; Danvers, MA) but less than 20% increase in the activity of the STAT pathway as measured using Phospho-Stat2 (Tyr690) antibody (Cell Signaling Technology; Danvers, MA) when exposed to or expressed in a test human T cell as compared to a control human T cell. In some embodiments, a selective NF-κB activator induces more than 20% (e.g., more than 30%, 40%, 50%, 60%, 70%, 80%, 90%, 100%) increase in NF-κB activity as measured by Phospho-IκBα (Ser32) antibody (e.g., 14D4, Clone Cell Signaling Technology; Danvers, MA) but less than 20% increase in the activity of the STAT pathway as measured using Phospho-Stat3 (Tyr705) antibody (e.g., Clone D3A7, Cell Signaling Technology; Danvers, MA) when exposed to or expressed in a test human T cell as compared to a control human T cell. In some embodiments, a selective NF-κB activator induces more than 20% (e.g., more than 30%, 40%, 50%, 60%, 70%, 80%, 90%, 100%) increase in NF-κB activity as measured by Phospho-IκBα (Ser32) antibody (e.g., 14D4, Clone Cell Signaling Technology; Danvers, MA) but less than 20% increase in the activity of the STAT pathway as measured using Phospho-Stat5 (Tyr694) antibody (e.g., Clone D47E7, Cell Signaling Technology; Danvers, MA) when exposed to or expressed in a test human T cell as compared to a control human T cell. In some embodiments, a selective NF-κB activator induces more than 20% (e.g., more than 30%, 40%, 50%, 60%, 70%, 80%, 90%, 100%) increase in NF-κB activity as measured by Phospho-IκBα (Ser32) antibody (e.g., 14D4, Clone Cell Signaling Technology; Danvers, MA) but less than 20% increase in the activity of the ERK pathway as measured using Phospho-p44/42 MAPK (Erk1/2) (Thr202/Tyr204) (e.g., Clone D13.14.4E, Cell Signaling Technology; Danvers, MA) when exposed to or expressed in a test human T cell as compared to a control human T cell.

Alternate methods of measuring the activation of the NF-κB, AKT, JNK, p38, ERK, JAK/STAT and interferon signaling pathways are known in the art and can be used to identify selective activator of the NF-κB signaling pathway. For example, a selective NF-κB activator induces greater increase in the NF-κB DNA binding activity when exposed to or expressed in a target cell (e.g., a T cell or 293FT cell) as compared to increase in c-Jun, c-Fos, JunD, ATF2, STAT3, NFAT1c, ELK-1, CREB, IRF3 or IRF7 DNA binding activities. Kits to measure DNA binding activities of different transcription factors belonging to different signaling pathways are available commercially (e.g., TransAM® Transcription Factor Assays; Active Motif) and can be used to identify selective activator of the NF-κB signaling pathway.

In an embodiment, a selective NF-κB activator induces greater increase in the ratio of increase in IκBα phosphorylation to increase in AKT phosphorylation as compared to CD28 when both of them are expressed in human T cells or when signaling through both is activated in human T cells under comparable conditions. In an embodiment, a selective NF-κB activator induces greater fold increase in the ratio of increase in IκBα phosphorylation to increase in AKT phosphorylation as compared to 41BB when both of them are expressed in human T cells under comparable conditions or when signaling through both is activated in human T cells under comparable conditions. In an embodiment, a selective NF-κB activator when co-expressed with a $1^{st}$ generation CAR lacking a costimulatory domain induces greater increase in the ratio of increase in IκBα phosphorylation to increase in AKT phosphorylation as compared to a 2nd generation CAR containing a CD28 costimulatory domain when both of them are expressed in human T cells and exposed to target antigen containing cells under comparable conditions. In an embodiment, a selective NF-κB activator when co-expressed with a 1$^{st}$ generation CAR lacking a costimulatory domain (e.g., a CAR represented by SEQ ID NO: 1016) induces greater increase in the ratio of increase in IκBα phosphorylation to increase in AKT phosphorylation as compared to a 2$^{nd}$ generation CAR containing a 41BB costimulatory domain (e.g., a CAR represented by SEQ ID NO: 1318) when both of them are expressed in human T cells and exposed to target antigen containing cells (e.g., RAJI) under comparable conditions. For example, T cells expressing the CD19-directed first generation CAR co-expressing K13 (CD8SP-FMC63-(vL-vH)-Myc-z-P2A-K13-Flag-T2A-PAC; SEQ ID NO: 1016) show greater increase in the ratio of IκBα phosphorylation to AKT phosphorylation as compared to T cells expressing the CD19-directed 2$^{nd}$ generation CAR with 41BB costimulatory domain (CD8SP-FMC63-(vL-vH)-Myc-BBz-T2A-PAC; SEQ ID NO: 1318) when both the CAR-T cells are exposed to RAJI cells at E:T ratio of 1:5 for between 1-24 hours. The phosphorylation of IκBα and AKT are calculated by using methods known in the art (e.g., immunoblotting or Flow cytometry) using antibodies specific to their phosphorylated forms. The increase in IκBα phosphorylation is calculated by subtracting the IκBα phosphorylation in control T cells lacking the expression of CAR from the IκBα phosphorylation in CAR-T cells after exposure to RAJI cells. The increase in AKT phosphorylation is calculated by subtracting the AKT phosphorylation in control T cells lacking the expression of CAR from the AKT phosphorylation in CAR-T cells after exposure to RAJI cells. The ratio of increase in IκBα to increase in AKT phosphorylation is calculated by dividing the increase in IκBα phosphorylation from the increase in AKT phosphorylation.

In an embodiment, a selective NF-κB activator induces greater increase in the ratio of increase in p65/RelA phosphorylation to increase in AKT phosphorylation as compared to CD28 when both of them are expressed in human T cells or when signaling through both is activated in human T cells under comparable conditions. In an embodiment, a selective NF-κB activator induces greater fold increase in the ratio of increase in p65/RelA phosphorylation to increase in AKT phosphorylation as compared to 41BB when both of them are expressed in human T cells under comparable conditions or when signaling through both is activated in human T cells under comparable conditions. In an embodiment, a selective NF-κB activator when co-expressed with a 1$^{st}$ generation CAR lacking a costimulatory domain induces greater increase in the ratio of increase in p65/RelA phosphorylation to increase in AKT phosphorylation as compared to a 2$^{nd}$ generation CAR containing a CD28 costimulatory domain when both of them are expressed in human T cells and exposed to target antigen containing cells under comparable conditions. In an embodiment, a selective NF-κB activator when co-expressed with a 1$^{st}$ generation CAR lacking a costimulatory domain (e.g., a CAR represented by SEQ ID NO: 1016) induces greater increase in the ratio of increase in p65/RelA phosphorylation to increase in AKT phosphorylation as compared to a 2$^{nd}$ generation CAR containing a 41BB costimulatory domain (e.g., a CAR represented by SEQ ID NO: 1318) when both of them are expressed in human T cells and exposed to target antigen containing cells (e.g., RAJI) under comparable conditions. For example, T cells expressing the CD19-directed first generation CAR co-expressing K13 (CD8SP-FMC63-(vL-vH)-Myc-z-P2A-K13-Flag-T2A-PAC; SEQ ID NO: 1016) show greater increase in the ratio of p65/RelA phosphorylation to AKT phosphorylation as compared to T cells expressing the CD19-directed 2$^{nd}$ generation CAR with 41BB costimulatory domain (CD8SP-FMC63-(vL-vH)-Myc-BBz-T2A-PAC; SEQ ID NO: 1318) when both the CAR-T cells are exposed to RAJI cells at an Effector:Target (E:T) ratio of 1:5 for between 1-24 hours (e.g., 1 hour, 2 hours, 4 hours, 12 hours, or 24 hours). The phosphorylation of p65/RelA and AKT are calculated by using methods known in the art (e.g., immunoblotting or Flow cytometry) using antibodies specific to their phosphorylated forms. The increase in p65/RelA phosphorylation is calculated by subtracting the p65/RelA phosphorylation in control T cells lacking the expression of CAR from the p65/RelA phosphorylation in CAR-T cells after both are exposed to RAJI cells. The increase in AKT phosphorylation is calculated by subtracting the AKT phosphorylation in control T cells lacking the expression of CAR from the AKT phosphorylation in CAR-T cells after both are exposed to RAJI cells. The ratio of increase in p65/RelA to increase in AKT phosphorylation is calculated by dividing the increase in p65/RelA phosphorylation from the increase in AKT phosphorylation.

In an embodiment, a selective NF-κB activator when co-expressed with a 1$^{st}$ generation CAR lacking a costimulatory domain (e.g., a CAR represented by SEQ ID NO: 1016) induces greater increase in the ratio of increase in IκBα phosphorylation to increase in JNK, ERK, or p38 kinase phosphorylation as compared to a 2$^{nd}$ generation CAR containing a 41BB costimulatory domain (e.g., a CAR represented by SEQ ID NO: 1318) when both of them are expressed in human T cells and exposed to target antigen containing cells (e.g., RAJI) for appropriate time interval (e.g., 1-24 hours) under comparable conditions. In an embodiment, a selective NF-κB activator when co-expressed with a 1$^{st}$ generation CAR lacking a costimulatory domain (e.g., a CAR represented by SEQ ID NO: 1016) induces greater increase in the ratio of increase in p65/RelA phosphorylation to increase in JNK, ERK, or p38 kinase phosphorylation as compared to a 2$^{nd}$ generation CAR containing a 41BB costimulatory domain (e.g., a CAR represented by SEQ ID NO: 1318) when both of them are expressed in human T cells and exposed to target antigen containing cells (e.g., RAJI) for appropriate time interval (e.g., 1-24 hours) under comparable conditions.

In one embodiment, a NF-κB activator, including a selective NF-κB activator, is a non-naturally occurring agent and is expressed in the cell exogenously. In one embodiment, the selective NF-κB activator is of viral origin, i.e., it is encoded by a virus or is derived from a virally encoded protein or has a domain of more than 10 amino acid residues (e.g., more than 15 amino acid residues, 20 amino acid residues, 30 amino acid residues or 50 amino acid residues) with more than 80% (e.g., more than 85%, 90%, 95%, or 99%) identity to one or more viral proteins. An exemplary selective NF-κB activator of viral origin is vFLIP K13 (SEQ ID NO:) which is derived from Kaposi's sarcoma associated herpesvirus. In another embodiment, the selective NF-κB activator is of mammalian or cellular origin. Exemplary selective NF-κB activators of mammalian origin are human NEMO-K277A mutant, human NEMO-K277-deltaV249-K255 mutant, mouse NEMO-K270A mutant, IKK2-5177E-5181E and IKK1-5176E-5180E. In another embodiment, the selective NF-κB activator is of human origin; i.e. it has a domain of more than 10 amino acid residues (e.g., more than 15 amino acid residues, 20 amino acid residues, 30 amino acid residues or 50 amino acid residues) with more than 80% (e.g., more than 85%, 90%, 95%, or 99%) identity to one or more human proteins. In some embodiments, a selective NF-κB activator is composed of two or more fusion proteins (e.g., FKBPx2-NEMO). In some embodiments, the two or more fusion partners of a selective NF-κB activator are each derived from human proteins or have more than 80% identity to the human proteins.

In some embodiments, the selective NF-κB activator is encoded by the wild-type nucleic acid sequence while in other embodiments the selective NF-κB activator is encoded by codon-optimized nucleic acid sequence or a mutant sequence. In an exemplary embodiment, vFLIP K13 is encoded by human codon optimized nucleic acid sequence, e.g., K13-opt (SEQ ID NO: 7768).

In some embodiments, the immune cells express a single selective NF-κB activator while in other embodiments the immune cells express more than one selective NF-κB activator (e.g., NEMO-K277A plus K13-opt or IKK2-S177E-S181E plus IKK1-S176E-S180E).

In some embodiments, the selective NF-κB activator is expressed in an immune cell in a constitutive manner. In other embodiments, the selective NF-κB activator is expressed in an immune cell in an inducible manner. In an exemplary embodiment, inducible expression of a selective NF-κB activator can be achieved through the use of an inducible promoter. Examples of inducible promoters include, but are not limited to a metallothionine inducible promoter, a glucocorticoid inducible promoter, a progesterone inducible promoter, and a tetracycline inducible promoter. RheoSwitch® system represents another transcriptional regulator platform for controlling the expression of a protein.

Methods to control the activity of proteins are known in the art and can be used to control the activity of the NF-κB activator, including selective NF-κB activator. In an exemplary embodiment, this involves the expression in the target cell, such as a T cell or an NK cell, of a NEMO or a NEMO mutant fused to a dimerization domain or a switch domain. In an exemplary embodiment, the switch domain comprises of one or more copies of a FKBP12 domain or an FKBP12v36 domain. In some embodiments, the switch domain is attached to the carboxy-terminus of the NF-κB activator (e.g., NEMO) while in other embodiments the switch domain is attached to the amino-terminus of the NF-κB activator (e.g., NEMO). Exposure of target cells expressing such a fusion protein to a suitable dimerizer (e.g., Rimiducid) results in oligomerization of NEMO, which in turn leads to NF-κB activation. In an alternate embodiment, the activity of the selective NF-κB activators can be also controlled by fusing them to the ligand binding domain of a mutated estrogen receptor as has been described (Matta H et al., Journal of Biological Chemistry, 282, 34, 2007). The mutated estrogen receptor does not bind to the physiological ligand estrogen but binds with very high affinity to the synthetic ligand 4-OHT (4-hydroxytamoxifen) and regulates the activity of the fusion partner (e.g., NF-κB activator, e.g., vFLIP K13 or NEMO) in a 4-OHT-dependent fashion.

In some embodiments, the selective NF-κB activator is expressed in the immune cells by alteration in its genomic copy using gene editing techniques known in the art. In an exemplary embodiment, a gene editing system (e.g., TALON, Zn finger nuclease or CRISP/Cas9) is used to convert one or both alleles of human NEMO to human NEMO-K277A mutant form. In another exemplary embodiment, a gene editing system is used to convert one or both alleles of human NEMO to human NEMO-K277A-delta-V249-K255 mutant form. The sequence of human NEMO gene targeting constructs that can be used to induce K277A and K277A-delta-V249-K255 mutations are provided in SEQ ID NO: 7771 and 7772, respectively. These sequences can be cloned in a suitable vector (e.g., integration defective lentiviral vector, AAV vector or adenoviral vector). Examples of genomic target sequences for human NEMO for which CRISP/Cas9 gRNAs comprising complementary targeting sequences can be generated are provided in SEQ ID NO: 7759-7762. The gRNA sequences are cloned into the pX330-U6-Chimeric_BB-CBh-hSpCas9 vector (Addgene). Alternatively, the gRNA sequences can be cloned in the pLenti-CRISPR-v2 vector available from Addgene (Plasmid #52961) and following the instructions provided by the distributor. Introduction of the NEMO targeting construct and gRNA encoding constructs into the T cells is carried out essentially as described previously (Knipping F et al, Molecular Therapy: Methods & Clinical Development, Vol 4, 2017).

In another or further embodiment of any of the foregoing embodiments described herein, the immune effector cells that express an accessory module encoding a selective NF-κB activator (e.g., hNEMO-K277A, hNEMO-K277A-deltaV249-K555, mNEMO-K270A, K13-opt, IKK2-S177E-S181E, or IKK1-S176E-S180E) show improved in vitro activity (e.g. target antigen induced IL2 production, proliferation, expansion, and delay in terminal differentiation, delay in senescence etc.) against a target antigen expressing cell as compared to a corresponding immune effector cell lacking the accessory module when compared under similar conditions. NF-κB activation in the immune effector cells is measured by using techniques known in the art including, but not limited to, measurement of phosphorylated IκBα, phosphorylated p65, total IκBα, p65 nuclear translocation, upregulation of NF-κB responsive genes, electrophoretic mobility shift assay (EMSA) and NF-κB-based reporter assay etc. In some embodiments, selective NF-κB activation is determined by measuring fold increase in activation of NF-κB in the immune effector cells over the fold increase in activation of AKT pathway. In some embodiments, immune effector cells that express an accessory module encoding a selective NF-κB activator (e.g., K13-opt (human codon optimized K13) or hNEMO-K277A) show higher in vitro activity (e.g. target antigen induced IL2 production, proliferation, expansion, and delay in terminal differentiation, and delay in senescence) towards target antigen expressing cells as compared to the corresponding immune effector cells that lack the expression of an accessory module encoding a selective NF-κB activator (e.g., K13-opt or hNEMO-K277A) when both are tested under similar experimental conditions. In an exemplary embodiments, CD19-CAR-expressing immune effector cells that express an accessory module encoding a selective NF-κB activator (e.g., K13-opt (human codon optimized K13) or hNEMO-K277A) show higher in vitro activity (e.g. target antigen induced IL2 production, proliferation, expansion, and delay in terminal differentiation, and delay in senescence) towards Nalm6 cells as compared to the corresponding CD19-CAR-expressing effector cells that do not express an accessory module encoding a selective NF-κB activator (e.g., K13-opt or hNEMO-K277A) when both are tested under similar experimental conditions. In some embodiments, the in vitro activity (e.g. target antigen induced IL2 production, proliferation, expansion, and delay in terminal differentiation, and delay in senescence) of the immune effector cells that express an accessory module encoding a selective NF-κB activator against the target antigen-expressing cells (i.e. target cells) is at least 5%, 10%, 20%, 30%, 40%, 50% or 100% more than the in vitro activity of a corresponding immune effector cells that do not express an accessory module encoding a selective NF-κB activator. In some embodiments, the in vitro activity (e.g. target antigen induced IL2 production, proliferation, expansion, and delay in terminal differentiation, and delay in senescence) of the immune effector cells that express a selective NF-κB activator (e.g., hNEMO-K277A) against the target antigen-expressing cells (i.e. target cells) is at least 1.25-fold, 1.5-fold, 2-fold, 5-fold or 10-fold more than the in vitro activity of a corresponding immune effector cells that lack the expression of the selective NF-κB activator. In an embodiment, the immune effector T cells (e.g., CD19-CAR-T cells) that express a selective NF-κB activator produce at least 5%, 10%, 20%, 30%, 40%, 50% or 100% more IL2 when exposed to a target antigen expressing cell (e.g., Nalm-6 cells) as compared to the control immune effector T cells (e.g., CD19-CAR-T cells) that lack the expression of the selective NF-κB activator. In an embodiment, the immune effector T cells (e.g., CD19-CAR-T cells) that express a selective NF-κB activator show at least 5%, 10%, 20%, 30%, 40%, 50% or 100% more proliferation when exposed to a target antigen expressing cell (e.g., Nalm-6 cells) as compared to the control immune effector T cells (e.g., CAR-T cells) that lack the expression of the selective NF-κB activator. In an embodiment, the immune effector T cells (e.g., CD19-CAR-T cells) that express a selective NF-κB activator show at least 5%, 10%, 20%, 30%, 40%, 50% or 100% less markers of exhaustion when exposed to a target antigen expressing cell (e.g., Nalm-6 cells) as compared to the control immune effector T cells (e.g., CAR-T cells) that lack the expression of the selective NF-κB activator. In an embodiment, the immune effector T cells (e.g., CD19-CAR-T cells) that express a selective NF-κB activator show at least 5%, 10%, 20%, 30%, 40%, 50% or 100% less markers of terminal differentiation when exposed to a target antigen expressing cell (e.g., Nalm-6 cells) as compared to the control immune effector T cells (e.g., CAR-T cells) that lack the expression of the selective NF-κB activator. In an embodiment, the immune effector T cells (e.g., CD19-CAR-T cells) that express a selective NF-κB activator show at least 5%, 10%, 20%, 30%, 40%, 50% or 100% more cytotoxicity when serially exposed to target antigen expressing cells (e.g., Nalm-6 cells) over a period of 3-4 weeks as compared to the control immune effector T cells (e.g., CAR-T cells) that lack the expression of the selective NF-κB activator. In some embodiments, the immune effector cell that express an accessory module encoding a selective NF-κB activator is a T cell (e.g., a CD8 T cell, a CD4 T cell, a CAR-T cell, a TIL, a TREG cell, an NKT cell), a NK cell (e.g., a CAR-NK cell), a macrophage (e.g., a CAR-expressing macrophage), an antigen presenting cell (e.g., a dendritic cell), a stem cell, an induced pluripotent stem cell (iPSC) or a stem cell that can give rise to an immune effector cell.

In another or further embodiment of any of the foregoing embodiments described herein, the immune effector cells that express an accessory module encoding a selective NF-κB activator, show higher in vivo activity (e.g. in vivo expansion, in vivo persistence, tumor reduction, reduction in bioluminescence value obtained from a luciferase expressing tumor or animal survival) against a target antigen expressing cell as compared to control immune effector cells that do not express the accessory module encoding a selective NF-κB activator when both are tested under similar conditions. NF-κB activation in the immune effector cells is measured by using techniques known in the art including, but not limited to, measurement of phosphorylated IκBα, total IκBα, p65 nuclear translocation, upregulation of NF-κB responsive genes, electrophoretic mobility shift assay (EMSA) and NF-κB-based reporter assay etc. In some embodiments, selective NF-κB activation is determined by measuring fold increase in activation of NF-κB in the immune effector cells over the fold increase in activation of AKT pathway. For example, in some embodiments, CD19-CAR-expressing immune effector cells that express an accessory module encoding a selective NF-κB activator (e.g., K13-opt (human codon optimized K13) or hNEMO-K277A) show higher in vivo activity (e.g. in vivo expansion, in vivo persistence, tumor reduction, reduction in bioluminescence value obtained from a FLuc expressing tumor or animal survival) towards Nalm6-FLuc cells in an NSG mouse xenograft model as compared to the corresponding CD19-CAR-expressing effector cells that lack an accessory module encoding a selective NF-κB activator (e.g., K13-opt (human codon optimized K13) or hNEMO-K277A) when tested under similar experimental conditions. In some embodiments, the in vivo activity (e.g. in vivo expansion, in vivo persistence, tumor reduction, reduction in bioluminescence value obtained from a FLuc expressing tumor or animal survival) of the immune effector cells (e.g., CD19-CAR-T cells) that express an accessory module encoding a selective NF-κB activator against the target antigen-expressing cells (e.g., Nalm-6) in a NSG mouse xenograft model is at least 5, 10, 20, 30, 40, 50% or 100% more than the in vivo activity of a corresponding immune effector cells that lack an accessory module encoding a selective NF-κB activator. In some embodiments, the in vivo activity (e.g. in vivo expansion, in vivo persistence, tumor reduction, reduction in bioluminescence value obtained from a FLuc expressing tumor or animal survival) of the immune effector cells (e.g., CD19-CAR-T cells) that encode an accessory module encoding a selective NF-κB activator against the target antigen-expressing cells (e.g., Nalm6) in a NSG mouse xenograft model is at least 1.25-fold, 1.5-fold, 2-fold, 5-fold or 10-fold more than the in vivo activity of a corresponding immune effector cells that lack the expression of an accessory module encoding a selective NF-κB activator. In some embodiments, the immune effector cell expressing an accessory module encoding a selective NF-κB activator is a T cell (e.g., a CD8 T cell, a CD4 T cell, a CAR-T cell, a TIL, a TREG cell, an NKT cell), a NK cell (e.g., a CAR-NK cell), a macrophage (e.g., a CAR-expressing macrophage), an antigen presenting cell (e.g., a dendritic cell), a stem cell, an induced pluripotent stem cell (iPSC) or a stem cell that can give rise to an immune effector cell.

In another or further embodiment of any of the foregoing embodiments described herein, the immune effector cells expressing the accessory module, e.g., hNEMO-K277A, hNEMO-K277A-deltaV249-K555, mNEMO-K270A, K13-opt, IKK2-S177E-S181E, IKK1-S176E-S180E, or MYD88-L265P show higher in vivo activity (e.g. in vivo expansion, in vivo persistence, tumor reduction, reduction in bioluminescence value obtained from a FLuc expressing tumor or animal survival) against a target antigen expressing cell as compared to a corresponding immune effector cell lacking the accessory module when compared under similar conditions. For example, in some embodiments, CD19-CAR-expressing immune effector cells that also co-expresses hNEMO-K277A, hNEMO-K277A-deltaV249-K555, mNEMO-K270A, K13-opt, IKK2-S177E-S181E, IKK1-

S176E-S180E, or MYD88-L265P show higher in vivo activity (e.g. in vivo expansion, in vivo persistence, tumor reduction, reduction in bioluminescence value obtained from a FLuc expressing tumor or animal survival) towards Nalm6-FLuc cells in an NSG mouse xenograft model as compared to the corresponding CD19-CAR-expressing effector cells that lack hNEMO-K277A expression when tested under similar experimental conditions. In some embodiments, the in vivo activity (e.g. in vivo expansion, in vivo persistence, tumor reduction, reduction in bioluminescence value obtained from a FLuc expressing tumor or animal survival) of the immune effector cells expressing the accessory module described herein (e.g., hNEMO-K277A, hNEMO-K277A-deltaV249-K555, mNEMO-K270A, K13-opt, IKK2-S177E-S181E, IKK1-S176E-S180E, or MYD88-L265P) against the target antigen-expressing cells (i.e. target cells) in a NSG mouse xenograft model is at least 5, 10, 20, 30, 40, 50% or 100% more than the in vivo activity of a corresponding immune effector cell that lacks the expression of the accessory module. In some embodiments, the in vivo activity (e.g. in vivo expansion, in vivo persistence, tumor reduction, reduction in bioluminescence value obtained from a FLuc expressing tumor or animal survival) of the immune effector cells expressing the accessory module described herein (e.g., hNEMO-K277A, hNEMO-K277A-deltaV249-K555, mNEMO-K270A, K13-opt, IKK2-S177E-S181E, IKK1-S176E-S180E, or MYD88-L265P) against the target antigen-expressing cells (i.e. target cells) in a NSG mouse xenograft model is at least 1.25-fold, 1.5-fold, 2-fold, 5-fold or 10-fold more than the in vivo activity of a corresponding immune effector cell that lacks the expression of the accessory module. In some embodiments, the accessory module-expressing effector cell is a T cell (e.g., a CD8 T cell, a CD4 T cell, a CAR-T cell, a TIL, a TREG cell, an NKT cell), a NK cell (e.g., a CAR-NK cell), a macrophage (e.g., a CAR-expressing macrophage), an antigen presenting cell (e.g., a dendritic cell), an induced pluripotent stem cell (iPSC) or a stem cell that can give rise to an immune effector cell.

The disclosure further provides that expression of a selective NF-κB activator can be used to improve the cytokine secretion, antigen presentation and immune response generated by antigen presenting cells, including dendritic cells. The disclosure further provides a method of improving the efficacy of vaccine, including cancer vaccines, by expression of a selective NF-κB activator in the antigen presenting cells ex vivo or in vivo. In one embodiment, the use of selective NF-κB activators increase cytokine production (e.g., TNFα) by antigen presenting cells (e.g., dendritic cells) by more than at least 15%.

The disclosure further provides that an accessory module encoding CMV-141 (SEQ ID NO: 7770) can be expressed in the immune effector cells, e.g., T cells, e.g., CAR-T cells or TCR-T cells, to delay their exhaustion and improve their long term persistence. The CMV-141 can be expressed in immune effector cells in an inducible or constitutive manner.

In some embodiments, cells, e.g., T or NKT or stem cells or iPSC or synthetic T cell, are generated that express a non-naturally occurring immune receptor, e.g., CAR, and/or an NF-κB stimulatory molecule described herein by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease reengineered homing endonucleases).

In another embodiment, the disclosure provides a method of making a cell (e.g., an immune effector cell or population thereof) comprising introducing into (e.g., transducing) a cell, e.g., a T cell, a NKT cell or a stem cell or a iPSC or a synthetic T cell described herein, with a vector comprising a nucleic acid encoding a non-naturally occurring immune receptor, e.g., CAR, and/or an NF-κB stimulatory molecule.

In various embodiments, the cells for modifications with a non-natural immune receptor and/or NF-κB stimulatory molecule described herein, including T cells or NK cells may be obtained from a subject desiring therapy. T cells can be obtained from a number of sources, including peripheral blood mononuclear cells, bone marrow, lymph node tissue, cord blood, thymus tissue, tissue from a site of infection, ascites, pleural effusion, spleen tissue, and tumors. T cells could be tissue resident gamma-delta T cells, which can be cultured and expanded in vitro prior to expression of the non-naturally occurring immune receptor, e.g., CAR, and/or NF-κB stimulatory molecule.

In one embodiment, the disclosure provides a number of chimeric antigen receptors (CAR) comprising an antigen binding domain (e.g., antibody or antibody fragment, TCR or TCR fragment) engineered for specific binding to a disease-associated antigen, e.g., a tumor antigen described herein. In one embodiment, the disclosure provides an immune effector cell (e.g., T cell, NK cell) engineered to express a non-naturally occurring immune receptor (e.g., a CAR or a recombinant TCR) and/or NF-κB stimulatory molecule, wherein the engineered immune effector cell exhibits a therapeutic property. In one embodiment, the disclosure provides an immune effector cell (e.g., T cell, NK cell) engineered to express a non-naturally occurring immune receptor (e.g., a CAR or a recombinant TCR) and/or NF-κB stimulatory molecule, wherein the engineered immune effector cell exhibits anticancer or anti-infection (e.g., anti-HIV-1) property. In some embodiments, the NF-κB stimulatory molecule may be expressed in a T cell (e.g. a Tumor infiltrating lymphocyte or TIL) with its endogenous TCR, wherein the engineered immune effector cell exhibits anticancer or anti-infection (e.g., anti-HIV-1) property. In one embodiment, a cell is transformed with the non-naturally occurring immune receptor (e.g., a CAR or a recombinant TCR) and an NF-κB stimulatory molecule and the non-naturally occurring immune receptor is expressed on the cell surface. In some embodiments, the cell (e.g., T cell, NK cell) is transduced with a viral vector encoding a non-naturally occurring immune receptor (e.g., a CAR or a recombinant TCR) and/or NF-κB stimulatory molecule. In some embodiments, the viral vector is a retroviral vector. In some embodiments, the viral vector is a lentiviral vector. In some such embodiments, the cell may stably express the non-naturally occurring immune receptor (e.g., a CAR or a recombinant TCR) and/or NF-κB stimulatory molecule. In another embodiment, the cell (e.g., T cell, NK cell) is transfected with a nucleic acid, e.g., mRNA, cDNA, DNA, encoding a non-naturally occurring immune receptor (e.g., a CAR or a recombinant TCR) and/or NF-κB stimulatory molecule. In some such embodiments, the cell may transiently express the non-naturally occurring immune receptor (e.g., a CAR or a recombinant TCR) and/or NF-κB stimulatory molecule. In some embodiments, the NF-κB stimulatory molecule may be expressed in a T cell (e.g. a Tumor infiltrating lymphocyte or TIL) with its endogenous TCR.

The disclosure provides immune effector cells (e.g., T cells, NK cells) that are engineered to contain one or more non-naturally occurring immune receptors (e.g., CARs/TCRs) and/or NF-κB stimulatory molecules that direct the immune effector cells to diseased cells or disease-associated cells, such as cancer cells. This is achieved through an antigen binding domain on the immune receptor that is specific for a cancer associated antigen. There are two classes of cancer associated antigens (tumor antigens) that can be targeted by the CARs of the disclosure: (1) cancer associated antigens that are expressed on the surface of cancer cells; and (2) cancer associated antigens that itself is intracellular, however, a fragment of such antigen (peptide) is presented on the surface of the cancer cells by MHC (major histocompatibility complex). The disclosure also provides immune effector cells (e.g., T cells, NK cells) that contain endogenous TCRs and/or engineered to express one or more NF-κB stimulatory molecules that direct the immune effector cells to diseased cells or disease-associated cells, such as cancer cells.

Furthermore, the disclosure provides CARs, TCRs and CAR/TCR-expressing cells that also express an NF-κB stimulatory molecule and their use in medicaments or methods for treating, among other diseases, cancer or any malignancy or autoimmune diseases or infectious disease or degenerative disease or allergic disease involving cells or tissues which express a tumor antigen or disease associated antigen as described herein.

In one embodiment, the disclosure provides an immune effector cell (e.g., T cell, NK cell) engineered to express a non-naturally occurring immune receptor, e.g., CAR and/or TCR, and an NF-κB stimulatory molecule, wherein the engineered immune effector cell exhibits an anti-disease property, such as antitumor property. One type of antigen is a cancer associated antigen (i.e., tumor antigen) described herein. In one aspect, the antigen binding domain of the non-naturally occurring immune receptor, e.g., CAR, comprises a partially humanized antibody fragment. In one embodiment, the antigen binding domain of the non-naturally occurring immune receptor, e.g., CAR, comprises a partially humanized scFv. Accordingly, the disclosure provides non-naturally occurring immune receptors, e.g., CARs, that comprises a humanized antigen binding domain and is engineered into a cell, e.g., a T cell or a NK cell, wherein the cell also expresses an NF-κB stimulatory molecule and methods of their use for adoptive therapy.

In one embodiment, the disclosure provides an immune effector cell (e.g., T cell, NK cell) with its endogenous immune receptor (e.g. a TCR) that is engineered to express an NF-κB stimulatory molecule, wherein the engineered immune effector cell exhibits an anti-disease property, such as antitumor property or anti-HIV-1 property.

Further provided herein are genetically engineered cells, comprising the polynucleotides and/or the non-naturally occurring immune receptors described herein. In some embodiments, the cell is a T-lymphocyte (T-cell). In some embodiment the cell is a naïve T cells, a central memory T cells, an effector memory T cell, a regulatory T cell (Treg) or a combination thereof. In some embodiments, the cell is a natural killer (NK) cell, a hematopoietic stem cell (HSC), an embryonic stem cell, or a pluripotent stem cell. Genetically engineered cells which may comprise and express the non-naturally occurring immune receptors (e.g., CARs and/or TCRs) of the disclosure in combination with an NF-κB stimulatory molecule, include, but are not limited to, T-lymphocytes (T-cells), naïve T cells (TN), memory T cells (for example, central memory T cells (TCM), effector memory cells (TEM)), natural killer cells, hematopoietic stem cells and/or pluripotent embryonic/induced stem cells capable of giving rise to therapeutically relevant progeny. In an embodiment, the genetically engineered cells are autologous cells. In an embodiment, the genetically engineered cells are allogeneic cells. By way of example, individual T-cells of the invention may be CD4+/CD8−, CD4−/CD8+, CD4−/CD8− or CD4+/CD8+. The T-cells may be a mixed population of CD4+/CD8− and CD4−/CD8+ cells or a population of a single clone. CD4+ T-cells of the invention may produce IL-2, IFNγ, TNFα and other T-cell effector cytokines when co-cultured in vitro with cells expressing the target antigens (for example CD20+ and/or CD19+ tumor cells). CD8+ T-cells of the invention may lyse antigen-specific target cells when co-cultured in vitro with the target cells. In some embodiments, T cells may be any one or more of CD45RA+ CD62L+ naïve cells, CD45RO+ CD62L+ central memory cells, CD62L-effector memory cells or a combination thereof (Berger et al., Adoptive transfer of virus-specific and tumor-specific T cell immunity. *Curr Opin Immunol* 2009 21(2)224-232). Genetically modified cells may be produced by stably transfecting cells with DNA encoding the non-naturally occurring immune receptors (e.g., CARs and/or TCRs) and/or NFκB stimulatory molecule of the disclosure. The transfected cells demonstrating presence of a single integrated un-rearranged vector and expression of the non-naturally occurring immune receptors (e.g., CARs and/or TCRs) and/or NF-κB stimulatory molecule may be expanded ex vivo. In one embodiment, the cells selected for ex vivo expansion are CD8+ and demonstrates the capacity to specifically recognize and lyse antigen-specific target cells.

Stimulation of the T-cells by an antigen under proper conditions results in proliferation (expansion) of the cells and/or production of IL-2. The cells comprising the non-naturally occurring immune receptors (e.g., CARs and/or TCRs) and/or NF-κB stimulatory molecule of the disclosure will expand in number in response to the binding of one or more antigens to the antigen-specific targeting regions of the non-naturally occurring immune receptors (e.g., CARs and/or TCRs). The disclosure also provides a method of making and expanding cells expressing a non-naturally occurring immune receptor (e.g., CAR and/or TCR). The method comprises transfecting or transducing the cells with the vector(s) expressing the non-naturally occurring immune receptor (e.g., CAR and/or TCR) and/or NF-κB stimulatory molecule and stimulating the cells with cells expressing the target antigens, recombinant target antigens, or an antibody to the receptor to cause the cells to proliferate, so as to make and expand T-cells. In an embodiment, the cells may be any one or more of T-lymphocytes (T-cells), natural killer (NK) cells, hematopoietic stem cells (HSCs) or pluripotent embryonic/induced stem cells capable of giving rise to therapeutically relevant progeny. In an embodiment, the NF-κB stimulatory molecule can be expressed in the cells (e.g., T cells, NK cells, or stem cell that can give rise to immune cells) without the introduction of the non-naturally occurring immune receptors (e.g., CARs and/or TCRs).

Immune effector cells such as T cells and NK cells comprising non-naturally occurring immune receptors (e.g., CARs and/or TCRs) and/or NF-κB stimulatory molecule as described herein may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005.

In one embodiment, the genetically engineered cells comprise nucleic acid molecules encoding conventional CARs 1 to 6 or conventional CARs 1 to 6 which are part of the backbones described herein, such as backbone-1, backbone-2, backbone-13, backbone-14, backbone-37, backbone-38, backbone-49, backbone-50, backbone-60 or backbone-61, and an NF-κB stimulatory molecule wherein the antigen-specific domain of the CARs is specific to MPL, CD19, CD20, BCMA, CD22, CD30, CD33, CD123, CD138, CLL1, TCR-beta 1 constant chain, TCR-beta2 constant chain, TCRgamma/delta, mesothelin, IL13Ra2, ALK, PTK7, DLL3, TROP2, Timl, LAMP1, CS1, Lyml, Lym2, TSHR, NY-ESO-1/MHC class 1 complex, WT1/MHC class I complex, Ras/MHC class I complex, AFP/MHC class I complex, HPV-E6/MHC class I complex, HPV-E7/MHC class I complex, CD179a, CLD18A2, CD43 epitope, or HIV1 env protein gp120.

In one embodiment, the cell is a T cell and the T cell is deficient in one or more of endogenous T cell receptor chains. T cells stably lacking expression of a functional TCR according to the disclosure may be produced using a, variety of approaches such as use of Zn finger nucleases (ZFN), CRISP/Cas9 and shRNA targeting the endogenous T cell receptor chains. A non-limiting exemplary method relating to shRNAs is described in US 2012/0321667A1, which is incorporated herein by reference. Another non-limiting exemplary method relating to eliminating endogenous TCR expression using ZFNs targeting constant regions of α and β chains of TCRs is described in Torikai H et al. (Blood, 119(24), Jun. 14, 2012).

A T cell lacking a functional endogenous TCR can be, e.g., engineered such that it does not express any functional endogenous TCR on its surface, engineered such that it does not express one or more subunits (e.g. constant chains of endogenous TCRα, TCRβ1, TCRβ2, TCRγ, TCRδ or pre-TCRα) that comprise a functional endogenous TCR or engineered such that it produces very little functional endogenous TCR on its surface. Alternatively, the T cell can express a substantially impaired endogenous TCR, e.g., by expression of mutated or truncated forms of one or more of the subunits of the TCR. The term "substantially impaired TCR" means that this TCR will not elicit an adverse immune reaction in a host. In yet a further alternative a non-naturally occurring immune receptor (e.g., CAR and/or TCR) and/or NF-κB stimulatory molecule can be cloned into a TCR loci in at T cell genome and thus the non-naturally occurring immune receptors (e.g., CARs and/or TCRs) and/or NF-κB stimulatory molecule would be under the control of the endogenous T cell expression system.

The disclosure demonstrates that in contrast to the situation with the 1$^{st}$ or the 2$^{nd}$ generation CAR constructs, TFPs based on CD3ε, CD3γ, and CD3δ chains (designated as CD3ε/γ/δ TFPs) have poor expression and activity when expressed in αβ T cells that lack or have impaired functional endogenous or native TCRα chain polypeptide on their surface. For example, it is observed that CD3ε/γ/δ TFPs have impaired expression and activity (e.g., T cell activation, proliferation, cytokine production and cytotoxicity etc.) in αβ T cell in which the endogenous TRAC genomic locus has been disrupted by the TFP expression cassette. The disclosure provides a solution to this problem by re-expressing a TCRα constant chain (TRAC chain) polypeptide or a fragment thereof in T cells in which the expression of native full length TCRα chain polypeptide has been reduced or eliminated. In an embodiment, the re-expressed TCRα constant chain polypeptide or TCRα constant chain fragment allows the reconstitution of a functional CD3ε/γ/δ TFP-TCR-CD3 signaling complex in a αβ T cell in which the expression of the native TCRα constant chain is impaired, reduced or eliminated. In an embodiment, the re-expressed TCRα constant chain or TCRα constant chain fragment improves by more than 15% (e.g., more than 20%, 50%, 75%, or 100% etc.) target antigen-induced cytokine (e.g., IL2, TNFα, IFNγ) production, proliferation and/or cytotoxic activity of CD3ε/γ/δ TFP-expressing αβ T cell in which the expression of the native TCRα constant chain is impaired, reduced or eliminated. In an embodiment, the re-expressed TCRα constant chain or TCRα constant chain fragment allows enhanced expression of the CD3ε/γ/δ TFP in a αβ T cell in which the expression of the native TCRα constant chain is impaired, reduced or eliminated. In an embodiment, the re-expressed TCRα constant chain or TCRα constant chain fragment allows more than 15% (e.g., more than 20%, 50%, 75%, or 100% etc.) increase in expression of the CD3ε/γ/δ TFP in a αβ T cell in which the expression of the native TCRa constant chain is impaired, reduced or eliminated. In an exemplary embodiment, the expression and signaling activity of CD3ε/γ/δ TFPs can be restored in αβ T cells in which the expression of native TCRα chain is reduced or eliminated by introducing into such T cells a nucleic acid construct encoding an exogenous TCRα constant chain (TRAC chain) (e.g., SEQ ID NO: 1010). In a preferred embodiment, the nucleotide sequence encoding the exogenous TRAC chain is codon optimized and differs from the endogenous or native TCRα constant chain in its nucleotide sequence. In an alternate embodiment, the nucleotide sequence encoding the exogenous TRAC chain is codon optimized and carries one or more amino acid substitutions that are known to enhance the expression of human TCRα constant chain (see Table 3). In an exemplary embodiment, the exogenous TRAC chains that can be used to allow re-expression and/or activity of TFP-TCR-CD3 complex in αβ T cells in which the expression of endogenous TCRα gene has been down-regulated or eliminated have sequence as shown in SEQ ID NO: 3886 to 3894 or have sequences which encode for polypeptides with greater than 80% homology to the polypeptides encoded by sequences shown in SEQ ID NO: 3886 to 3894. To enable its cell surface expression, the nucleotide sequence encoding the exogenous TCRα constant chain (TRAC) is operationally linked to nucleotide sequence encoding a signal peptide. In an embodiment, additional non-naturally occurring sequences (e.g., linkers or antigen binding domain) may be optionally added to the sequence encoding the TRAC chain as long as they do not interfere with its ability to recruit other components of the TCR-CD3 signaling complex and/or CD3ε/γ/δ TFP. In an embodiment, the exogenous TCRα constant chain polypeptide is not operationally linked to the native Va sequence (i.e. antigen binding domain) present in the T cell in which it is expressed. In an embodiment, the expression of exogenous TCRα constant chain polypeptide does not allow the αβ T cell to regain its native antigen recognition specificity and/or affinity, e.g., to recognize the MHC-peptide antigen complex which was recognized by the T cell with its endogenous TCRα chain. In an exemplary embodiment, the accessory module encoding an exogenous TCRa constant chain can be expressed in αβ T cells either by itself (SEQ ID NO: 1010) using an appropriate method (e.g., lentiviral mediated gene transfer) or it can be co-expressed with the TFP expression cassettes using a single vector (e.g. a lentiviral vector). Alternate methods of delivery and expression of two or more genes or RNAs are known in the art and described in this disclosure and can be used in the alternate embodiments of the invention. The nucleotide sequence of exemplary constructs coexpressing a TCRα constant chain with CD3ε/γ/δ TFP constructs targeting MPL are shown in SEQ ID NOs: 3538, 3540, and 3542. In the exemplary construct CD8SP-MPL-Hu-161-2-(vL-vH)-CD3e-ECDTMCP-opt2-F-P2A-IgSP4-[TRAC-opt2] (SEQ ID NO: 3538), the first cassette encodes a CD3ε-TFP comprising a CD8 signal peptide followed by a humanized scFV targeting the human MPL protein and extracellular, transmembrane and cytosolic domain of CD3E. This TFP encoding cassette is followed in frame by a linker encoding Furine-SGSG-P2A and a cassette encoding a signal peptide (IgSP) and a codon optimized nucleotide sequence encoding TRAC. In an exemplary embodiment, the entire cassette can be expressed in αβ T cells lacking endogenous TCRa chain using a lentiviral vector.

In an alternate embodiment, the expression of TCRα constant chain polypeptide can be restored in αβ T cells that lack or have impaired functional endogenous or native TCRα chain polypeptide on their surface by using the endogenous TCRα constant chain gene. In an exemplary embodiment, the expression of TCRα constant chain polypeptide can be restored in αβ T cells that lack or have impaired functional endogenous or native TCRα chain polypeptide on their surface by functionally linking in frame a nucleic acid sequence encoding a signal peptide to at least one copy of the endogenous TCRα constant chain gene using techniques of gene editing known in the art. In an exemplary embodiment, the nucleic acid sequence encoding a signal peptide is operationally linked in frame to the first exon of at least one of the endogenous TCRα constant chain genes so as to allow the expression of a TCRα constant chain polypeptide on the surface of the T cells. In an embodiment, the expression cassette encoding the signal peptide and TCRα constant chain gene is under the transcriptional regulatory control of the endogenous TCRα promoter. In an embodiment, the expression cassette encoding the signal peptide and TCRα constant chain gene shares the 3' untranslated sequence and regulatory control of the endogenous TCRα gene. In an alternate embodiment, the expression cassette encoding the signal peptide and TCRα constant chain gene is under an exogenous promoter (e.g., EF1α or CMV promoter).

In an exemplary embodiment, expression of TCRα constant chain polypeptide can be restored in αβ T cells in which the endogenous or the native TCRα chain gene has been disrupted by targeted integration of a cassette encoding a TFP by designing the targeting cassette such that TFP cassette is followed in frame by a 2A cleavable linker, a signal peptide (e.g., a CD8 signal peptide or an IgH signal peptide) and the first exon of the TCRα constant chain (TRAC) (FIG. 5C). An exemplary such targeting construct is represented by SEQ ID NO: 3860. In this embodiment, the TCRα constant chain is expressed from the endogenous TCRα constant chain (TRAC) gene whose cell surface expression is facilitated by the signal peptide present in the targeting cassette. In this embodiment, the TCRα constant chain is expressed under the regulatory control of the TCRα gene promoter and TCRα 3' untranslataed region. An alternate exemplary targeting construct is represented by SEQ ID NO: 3859 and can be used in alternate embodiments of the disclosure to disrupt the endogenous TCRα chain by targeting integration of a cassette encoding a TFP while simultaneously allowing re-expression of a TCRα constant chain from an expression cassette encoding a signal peptide followed by a codon optimized TCRα constant chain cDNA and a polyA sequence (FIG. 5B).

The disclosure also demonstrates that in contrast to the situation with the $1^{st}$ or the $2^{nd}$ generation CAR constructs, CD3ε/γ/δ TFPs lose their activity when expressed in αβ T cells (i.e. T cells expressing TCRα and TCRβ chains) that lack or have impaired functional endogenous or native TCRβ1 and TCRβ2 chain polypeptides on their surface. For example, the disclosure provides that CD3ε/γ/δ TFPs have impaired expression and activity (e.g., T cell activation, proliferation, cytokine production and cytotoxicity etc.) in αβ T cells in which the endogenous TCRβ1 and TCRβ2 genomic loci have been disrupted. The disclosure provides a solution to this problem by re-expressing TCRβ1 or TCRβ2 constant chain polypeptides or a fragment thereof in T cells in which the expression of native full length TCRβ1 and TCRβ2 chain polypeptides have been reduced or eliminated. In an embodiment, the re-expressed TCRβ1/β2 constant chain polypeptide or TCRβ1/β2 constant chain fragment allows the reconstitution of a functional TFP-TCR-CD3 signaling complex in a T cell, e.g., a αβ T cell, in which the expression of the native TCRβ1 and/or β2 constant chain is impaired, reduced or eliminated. In an embodiment, the re-expressed TCRβ1/β2 constant chain or TCRβ1/β2 constant chain fragment improves by more than 15% (e.g., more than 20%, 50%, 75%, or 100% etc.) target antigen-induced cytokine (e.g., IL2, TNFα, IFNγ) production, proliferation and/or cytotoxic activity of TFP-expressing αβ T cell in which the expression of the native TCRβ1 and/or β2 constant chain is impaired, reduced or eliminated. In an embodiment, the re-expressed TCRβ1/β2 constant chain or TCRβ1/β2 constant chain fragment allows enhanced expression of the CD3ε/γ/δ TFP in a αβ T cell in which the expression of the native TCRβ1 and/or TCRβ2 constant chains is impaired, reduced or eliminated. In an embodiment, the re-expressed TCRβ1/β2 constant chain or TCRβ1/β2 constant chain fragment allows more than 15% (e.g., more than 20%, 50%, 75%, or 100% etc.) increase in expression of the CD3ε/γ/δ TFP in a αβ T cell in which the expression of the native TCRβ1 and/or TCRβ2 constant chain is impaired, reduced or eliminated. In an exemplary embodiment, the expression and signaling activity of CD3ε/γ/δ TFPs can be restored in T cells in which the expression of native TCRβ1 and/or TCRβ2 chain is reduced or eliminated by introducing into such T cells a nucleic acid construct encoding an exogenous TCRβ1/β2 constant chain (TRBC chain) (e.g., SEQ ID NO: 1011). In a preferred embodiment, the nucleotide sequence encoding the exogenous TCRβ1/β2 constant chain is codon optimized and differs from the endogenous or native TCRβ1 and TCRβ2 constant chains in its nucleotide sequence. In an alternate embodiment, the nucleotide sequence encoding the exogenous TCRβ1/β2 constant chain is codon optimized and carries one or more amino acid substitutions that are known to enhance the expression of human TCRβ1/β2 constant chain (see Table 4a, 4b). In an exemplary embodiment, the exogenous TCRβ1/β2 chains that can be used to allow re-expression and/or activity of TFP-TCR-CD3 complex in T cells in which the expression of endogenous TCRβ1 and β2 chains has been down-regulated or eliminated have sequence as shown in SEQ ID NO: 3895 to 3900 or have sequences which encode for polypeptides with greater than 80% homology to the polypeptides encoded by sequences shown in SEQ ID NO: 3895 to 3900. To enable its cell surface expression, the nucleotide sequence encoding the exogenous TCRβ1/β2 constant chain (TRBC) is operationally linked to nucleotide sequence encoding a signal peptide. In an embodiment, additional non-naturally occurring sequences (e.g., linkers or antigen binding domain) may be optionally added to the sequence encoding the TCRβ1/β2 constant chain (TRBC) as long as they do not interfere with its ability to recruit other components of the TCR-CD3 signaling complex and/or TFP. In an embodiment, the exogenous TCRβ1/β2 constant chain polypeptide is not operationally linked to the native Vβ sequence (i.e. antigen binding domain) present in the T cell in which it is expressed. In an embodiment, the expression of exogenous TCRβ1/β2 constant chain polypeptide does not allow the T cell to regain its native antigen recognition specificity and/or affinity, e.g., to recognize the MHC-peptide antigen complex which was recognized by the the T cell with its endogenous TCRβ1/β2 chain. In an exemplary embodiment, the accessory module encoding the exogenous TCRβ1/β2 constant chain can be expressed in T cells either by itself (e.g., SEQ ID NO: 1011) using an appropriate method (e.g., lentiviral mediated gene transfer) or it can be co-expressed with the CD3ε/γ/δ TFP expression cassettes using a single vector (e.g. a lentiviral vector). Alternate methods of delivery and expression of two or more genes or RNAs are known in the art and described in this disclosure and can be used in the alternate embodiments of the disclosure. The nucleotide sequence of exemplary constructs coexpressing a TCRβ constant chain with TFP constructs targeting MPL are shown in SEQ ID NOs: 3537, 3539, and 3541. In the exemplary construct CD8SP-MPL-Hu-161-2-(vL-vH)-CD3e-ECDTMCP-opt2-F-P2A-IgSP4-[TRBC-opt2] (SEQ ID NO: 3537), the first cassette encodes a TFP comprising a CD8 signal peptide followed by a humanized scFV targeting the human MPL protein and extracellular, transmembrane and cytosolic domain of CD3E. This TFP encoding cassette is followed in frame by a linker encoding Furine-SGSG-P2A and a cassette encoding a signal peptide (IgSP) and a codon optimized nucleotide sequence encoding a TCRβ constant chain (TRBC). In an exemplary embodiment, the entire cassette can be expressed in T cells lacking endogenous TCRβ chain using a lentiviral vector.

In an alternate embodiment, the expression of TCRβ1 or β2 constant chain polypeptide can be restored in αβ T cells that lack or have impaired functional endogenous or native TCRα chain polypeptide on their surface by using the endogenous TCRβ1 or β2 constant chain gene. In an exemplary embodiment, the expression of TCRβ1/β2 constant chain polypeptide and the co-expressed TFP can be restored in αβ T cells that lack or have impaired functional endogenous or native TCRβ chain polypeptide on their surface by operationally linking in frame a nucleic acid sequence encoding a signal peptide to at least one copy of the endogenous TCRβ1 or TCRβ2 constant chain gene using techniques of gene editing known in the art. In an exemplary embodiment, the nucleic acid sequence encoding a signal peptide is operationally linked in frame to the first exon of at least one of the endogenous TCRβ1 or TCRβ2 constant chain genes so as to allow the expression of a TCRβ1/β2 constant chain polypeptide and the coexpressed TFP on the surface of the T cells. In an embodiment, the expression cassette encoding the signal peptide and TCRβ1/β2 constant chain is under the transcriptional regulatory control of the endogenous TCRβ1/β2 promoter. In an embodiment, the expression cassette encoding the signal peptide and TCRβ1/β2 constant chain is under the 3' untranslated sequence and regulatory control of the endogenous TCRβ1/β2 gene. In an alternate embodiment, the expression cassette encoding the signal peptide and TCRβ1/β2 constant chain is under an exogenous promoter (e.g., EF1α or CMV promoter).

In an exemplary embodiment, expression of TCRβ1/β2 constant chain polypeptide can be restored in αβ T cells in which the endogenous or the native TCRβ1 and TCRβ2 chain genes have been disrupted by targeted integration of cassettes encoding a TFP by designing the targeting cassette such that TFP cassette is followed in frame by a 2A cleavable linker, a signal peptide (e.g., a CD8 signal peptide or an IgH signal peptide) and the first exon of the TCRβ1/β2 constant chain (TRBC).

It has been observed that directing the CAR cassette to the TRAC locus result in approximately 95% T cells becoming TCR negative. Such TCR-negative T cells could be used in an allogeneic setting as they are less likely to cause graft vs host disease (GVHD). However, re-expression of TRAC chain in T cells in which the TRAC locus has been targeted by a TFP cassette would potentially lead to expression of the full length TCRβ chain including the VP region. Such T cells, even though lacking the MHC recognition provided by Va region, would be potentially able to recognize allo-antigens presented by MHC complex through their TCRβ chains and therefore potentially cause GVHD. In alternate embodiments of the disclosure, both TCRα and TCRβ1 or (32 chains are re-expressed in CD3ε/γ/δ TFP-expressing αβ T cells in which the expression of endogenous TCRα and TCRβ1 and TCRβ2 chains have been down-regulated or eliminated.

In the above example, an exogenous TRAC or TRBC is coexpressed with a TFP-expressing construct to restore the expression and/or activity of CD3ε/γ/δ TFP in α/β T cells in which the expression of endogenous TCRα and/or TCRβ chains have been down-regulated or eliminated by, for example, targeting of their genomic loci. In an alternate embodiment of the invention, expression of exogenous TCRα and/or TCRβ1/β2 constant chains is used to restore TCR/CD3 complex expression in any α/β T cell, including a wild-type α/β T cell or an α/βT cell expressing a chimeric antigen receptor, a chimeric T cell receptor (cTCR), an AbTCR, or a synthetic immune receptor. Finally, a similar approach can be used to restore CAR/TFP and/or TCR/CD3 expression in γ/δ T cells in which the expression of endogenous TCRγ and/or TCR chains have been down-regulated or eliminated. Exemplary constant chains of TCRγ (TRGC) and TCRδ (TRDC) that can be expressed in γ/δ T cells in which the the expression of endogenous TCRγ and/or TCR chains have been down-regulated or eliminated are represented by SEQ ID NO: 3912 and 3913.

The disclosure also provides that the expression and activity of CD3ε/γ/δ TFP can be restored in T cells with impaired or lack of expression the native TCRα/β/γ or δ chains by re-expressing fragments or variants of the constant chains of TCRα/β/γ or δ. The of fragments/variants of constant chains of TCRα/β/γ and δ that can be used to restore the expression of CD3ε/γ/δ TFP in cells lacking the native TCRα/β/γ or δ chains are provided in SEQ ID Nos: 15141-15144 (Table 6D). The expression cassettes encoding these chains with a IgH signal peptide are listed in SEQ ID Nos: 15145-15148 (Table 7).

The disclosure further provides that the expression and activity of CD3ε/γ/δ TFP can be restored in T cells with impaired or lack of expression native TCRα/β/γ or δ chains by coexpression of a SIR or an Ab-TCR comprising the missing TCRα/β/γ or δ constant chains. Thus, in a αβ T cells with impaired or lack of expression of the native TCRa chain, the expression and activity of a CD3ε/γ/δ TFP can be rescued by expression of a SIR comprising a TCRα constant chain. In an exemplary embodiment, in a αβ T cells with impaired or lack of expression of the native TCRα chain, the expression and activity of a CD3ε/γ/δ TFP (e.g., a TFP encoded by SEQ ID NOs: 8708-8714) can be rescued by expression of a SIR (e.g., a SIR represented by SEQ ID NO: 9668, 9669, or 9684 etc.) comprising a TCRα constant chain. In another exemplary embodiment, in a αβ T cells with impaired or lack of expression of the native TCRα chain, the expression and activity of a CD3ε/γ/δ TFP (e.g., a TFP encoded by SEQ ID NOs: 8708-8714) can be rescued by expression of a Ab-TCR (e.g., a Ab-TCR represented by SEQ ID NO: 9677 or 9678 etc.) comprising a portion of TCRα constant chain. The disclosure provides that for combination therapies with allogeneic T cells involving two CARs, a CD3α/γ/δ TFP is preferably combined with a SIR and/or a Ab-TCR which incorporate the TCR constant chain or TCR constant chain fragment whose expression is reduced or missing in the allogeneic T cells.

The disclosure further provides that in a αβ T cells with impaired or lack of expression of the native TCRβ chains, the expression and activity of a CD3ε/γ/δ TFP can be rescued by expression of a SIR comprising a TCRβ constant chain. In an exemplary embodiment, in a αβ T cells with impaired or lack of expression of the native TCRβ1/β2 chains, the expression and activity of a CD3ε/γ/δ TFP (e.g., a TFP encoded by SEQ ID NOs: 8708-8714) can be rescued by expression of a SIR (e.g., a SIR represented by SEQ ID NO: 9668, 9669, or 9684 etc.) comprising a TCRβ constant chain. In another exemplary embodiment, in a αβ T cells with impaired or lack of expression of the native TCRα chain, the expression and activity of a CD3ε/γ/δ TFP (e.g., a TFP encoded by SEQ ID NOs: 8708-8714) can be rescued by expression of a Ab-TCR (e.g., a Ab-TCR represented by SEQ ID NO: 9677 or 9678 etc.) comprising a portion of TCRβ constant chain.

The disclosure further provides that in a γδ T cells with impaired or lack of expression of the native TCRγ chain, the expression and activity of a CD3ε/γ/δ TFP can be rescued by expression of a SIR comprising a TCRγ constant chain. In an exemplary embodiment, in a γδ T cells with impaired or lack of expression of the native TCRγ chain, the expression and activity of a CD3ε/γ/δ TFP (e.g., a TFP encoded by SEQ ID NOs: 8708-8714) can be rescued by expression of a SIR (e.g., a SIR represented by SEQ ID NO: 9689) comprising a TCRγ constant chain. In another exemplary embodiment, in a γδ T cells with impaired or lack of expression of the native TCRγ chain, the expression and activity of a CD3ε/γ/δ TFP (e.g., a TFP encoded by SEQ ID NOs: 8708-8714) can be rescued by expression of a Ab-TCR (e.g., a Ab-TCR represented by SEQ ID NO: 9676) comprising a portion of TCRγ constant chain.

The disclosure further provides that in a γδ T cells with impaired or lack of expression of the native TCRδ chain, the expression and activity of a CD3ε/γ/δ TFP can be rescued by expression of a SIR comprising a TCRδ constant chain. In an exemplary embodiment, in a γδ T cells with impaired or lack of expression of the native TCRδ chain, the expression and activity of a CD3ε/γ/δ TFP (e.g., a TFP encoded by SEQ ID NOs: 8708-8714) can be rescued by expression of a SIR (e.g., a SIR represented by SEQ ID NO: 9689) comprising a TCRδ constant chain. In another exemplary embodiment, in a γδ T cells with impaired or lack of expression of the native TCRδ chain, the expression and activity of a CD3ε/γ/δ TFP (e.g., a TFP encoded by SEQ ID NOs: 8708-8714) can be rescued by expression of a Ab-TCR (e.g., a Ab-TCR represented by SEQ ID NO: 9676) comprising a portion of TCRδ constant chain.

The disclosure also provides methods and constructs that allow a next generation CAR (e.g., SIR and AbTCR), cTCR, and TCR to be expressed under the physiological regulatory mechanisms afforded by endogenous TCR genes. The disclosure also provides methods and constructs that allow a next generation CAR (e.g., SIR and AbTCR), cTCR, and TCR to be expressed under the promoter and 3' untranslated regulatory mechanisms afforded by endogenous TCR genes. In one embodiment, the disclosure provides methods so that an expression cassette encoding a SIR/cTCR/Ab-TCR/TCR is targeted to the endogenous TCRα, TCRβ1/β2, TCRγ or TCRδ gene locus. In an embodiment, the SIR/cTCR/Ab-TCR/TCR is targeted to the endogenous TCRα gene locus (TRAC) so that the TCRα constant chain of the SIR/cTCR/Ab-TCR/TCR is expressed wholly or in part from the endogenous native TCRα constant chain gene. In an embodiment, the SIR/cTCR/Ab-TCR/TCR is targeted to the endogenous TCRα gene locus (TRAC) so that the TCRα constant chain of the SIR/cTCR/Ab-TCR/TCR is encoded completely or in part by at least one of the exons of the endogenous TCRα constant chain gene. In an embodiment, the SIR/cTCR/Ab-TCR/TCR is targeted to the endogenous TCRα gene locus (TRAC) so that the TCRα constant chain of the SIR/cTCR/Ab-TCR/TCR shares completely or in part the 3' untranslated region and polyadenylation sequence of the native/endogenous TCRα constant chain gene.

In an embodiment, the SIR/cTCR/Ab-TCR/TCR is targeted to the endogenous TCRβ gene locus (TRBC) so that the TCRβ constant chain of the SIR/cTCR/Ab-TCR/TCR is expressed wholly or in part from the endogenous native TCRβ1 or TCRβ2 constant chain gene. In an embodiment, the SIR/cTCR/Ab-TCR/TCR is targeted to the endogenous TCRβ1/β2 gene locus (TRBC) so that the TCRβ constant chain of the SIR/cTCR/Ab-TCR/TCR is encoded completely or in part by at least one of the exons of the endogenous TCRβ constant chain gene. In an embodiment, the SIR/cTCR/Ab-TCR/TCR is targeted to the endogenous TCRβ1/β2 gene locus (TRBC) so that the TCRβ constant chain of the SIR/cTCR/Ab-TCR/TCR shares completely or in part the 3' untranslated region and polyadenylation sequence of the native/endogenous TCRβ constant chain gene.

In an embodiment, the SIR/cTCR/Ab-TCR/TCR is targeted to the endogenous TCRγ gene locus (TRGC) so that the TCRγ constant chain of the SIR/cTCR/Ab-TCR/TCR is expressed wholly or in part from the endogenous native TCRγ constant chain gene. In an embodiment, the SIR/cTCR/Ab-TCR/TCR is targeted to the endogenous TCRγ gene locus (TRGC) so that the TCRγ constant chain of the SIR/cTCR/Ab-TCR/TCR is encoded completely or in part by at least one of the exons of the endogenous TCRγ constant chain gene. In an embodiment, the SIR/cTCR/Ab-TCR/TCR is targeted to the endogenous TCRγ gene locus (TRGC) so that the TCRγ constant chain of the SIR/cTCR/Ab-TCR/TCR shares completely or in part the 3' untranslated region and polyadenylation sequence of the native/endogenous TCRγ constant chain gene.

In an embodiment, the SIR/cTCR/Ab-TCR/TCR is targeted to the endogenous TCRδ gene locus (TRDC) so that the TCRδ constant chain of the SIR/cTCR/Ab-TCR/TCR is expressed wholly or in part from the endogenous native TCRδ constant chain gene. In an embodiment, the SIR/cTCR/Ab-TCR/TCR is targeted to the endogenous TCRδ gene locus (TRGC) so that the TCR constant chain of the SIR/cTCR/Ab-TCR/TCR is encoded completely or in part by at least one of the exons of the endogenous TCRδ constant chain gene. In an embodiment, the SIR/cTCR/Ab-TCR/TCR is targeted to the endogenous TCRδ gene locus (TRDC) so that the TCRδ constant chain of the SIR/cTCR/Ab-TCR/TCR shares completely or in part the 3' untranslated region and polyadenylation sequence of the native/endogenous TCRδ constant chain gene.

T cells or natural killer (NK) or stem cells, can be obtained from a subject. The term "subject" is intended to include living organisms in which an immune response can be elicited (e.g., mammals). Examples of subjects include humans, monkeys, chimpanzees, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors. T cells could be tissue resident gamma-delta T cells, which can be cultured and expanded in vitro prior to expression of the CAR/TCR and/or an NF-κB stimulatory molecule.

In certain embodiments of the disclosure, immune effector cells, e.g., T cells, can be obtained from a unit of blood collected from a subject using any number of techniques known to the skilled artisan, such as Ficoll™ separation. In one preferred aspect, cells from the circulating blood of an individual are obtained by apheresis. The apheresis product usually contains lymphocytes, including T cells, monocytes, granulocytes, B cells, other nucleated white blood cells, red blood cells, and platelets. In one aspect, the cells collected by apheresis may be washed to remove the plasma fraction and, optionally, to place the cells in an appropriate buffer or media for subsequent processing steps. In one embodiment, the cells are washed with phosphate buffered saline (PBS). In an alternative embodiment, the wash solution lacks calcium and may lack magnesium or may lack many if not all divalent cations.

Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter Cyto-Mate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" *Clinical & Translational Immunology* (2015) 4, e31; doi: 10.1038/cti.2014.31.

In one aspect, T cells are isolated from peripheral blood lymphocytes by lysing the red blood cells and depleting the monocytes, for example, by by counterflow centrifugal elutriation or centrifugation through a PERCOLL™ gradient.

In one embodiment, the disclosure provides methods of treating or preventing a disease by providing to the subject in need thereof immune effector cells (e.g., T cells) or stem cells that can give rise to immune effector cells that are engineered to express an X-CAR or a X-TCR and an NF-κB stimulatory molecule, wherein X represents a disease associated antigen as described herein, and wherein the disease causing or disease-associated cells express said X antigen. Table 9 provides a list of different antigens and the exemplary diseases that can be prevented, inhibited or treated using immune effector cells expressing CARs targeting these antigens.

In another embodiment, the disclosure provides methods of treating or preventing a cancer, infection, autoimmune or allergic diseases by providing to the subject in need thereof immune effector cells (e.g., T cells) or stem cells that can give rise to immune effector cells that are engineered to express a non-naturally occurring immune receptor (e.g., CAR and/or TCR) of the disclosure and/or an NF-κB stimulatory molecule. In one embodiment, the NF-κB stimulatory molecule is a selective NF-κB activator. In one embodiment, the NF-κB activator, e.g., a selective NF-κB activator, is a non-viral NF-κB activator. In one embodiment, the NF-κB activator, e.g., a selective NF-κB activator, is not a transmembrane protein and is expressed in the cytosol or is preferentially present in the cytosol. In one embodiment, the NF-κB activator, e.g., a selective NF-κB activator, is constitutively active. In one embodiment, the NF-κB activator, e.g., a selective NF-κB activator, is not constitutively active. In one embodiment, the selective NF-κB activator is activated by the administration of an inducer (e.g., a dimerizer). In one embodiment, the selective NF-κB activator is vFLIP K13, NEMO-K277A or its derivatives. The CAR/NF-κB stimulatory molecule-expressing immune effector cells are administered to the patient. In one aspect the disease associated cell is a cancer cell, an infected cell (e.g., HIV-1 infected cell), or a plasma cell or a B cell or a T cell.

In another embodiment, the disclosure provides methods of treating or preventing a cancer, infection, autoimmune or allergic diseases by providing to the subject in need thereof immune effector cells (e.g., T cells) or stem cells that can give rise to immune effector cells that are engineered to express a naturally occurring immune receptor (e.g., a native TCR) and an NF-κB stimulatory molecule. In one embodiment, the NF-κB stimulatory molecule is a selective NF-κB activator. In one embodiment, the NF-κB activator, e.g., a selective NF-κB activator, is a non-viral NF-κB activator. In one embodiment, the NF-κB activator, e.g., a selective NF-κB activator, is not a transmembrane protein and is expressed in the cytosol or is preferentially present in the cytosol. In one embodiment, the NF-κB activator, e.g., a selective NF-κB activator, is constitutively active. In one embodiment, the NF-κB activator, e.g., a selective NF-κB activator, is not constitutively active. In one embodiment, the selective NF-κB activator is activated by the administration of an inducer (e.g., a dimerizer). In one embodiment, the selective NF-κB activator is vFLIP K13, NEMO-K277A or its derivatives. The native TCR and NF-κB stimulatory molecule-expressing immune effector cells are administered to the patient. In one aspect the disease associated cell is a cancer cell, an infected cell (e.g., HIV-1 infected cell), or a plasma cell or a B cell or a T cell.

In another embodiment, the disclosure provides methods of treating or preventing a cancer, infection, autoimmune or allergic diseases by providing to the subject in need thereof immune effector cells (e.g., T cells) or stem cells that can give rise to immune effector cells that are engineered to express a naturally occurring (e.g., native TCR) or a non-naturally occurring immune receptor (e.g., CAR and/or recombinant TCR) of the disclosure and/or an NF-κB stimulatory molecule. In some embodiments, the activity of CAR-T or TCR-T cells may be controlled using a water soluble salt of Dasatinib.

In another aspect, a method of treating a subject, e.g., reducing or ameliorating a hyperproliferative disorder or condition (e.g., a cancer), e.g., solid tumor, a soft tissue tumor, a blood cancer, or a metastatic lesion, in a subject is provided.

In yet another embodiment, the disclosure pertains to a method of treating a disease in a subject. The method comprises administering to the subject a cell expressing a naturally occurring and/or a non-naturally occurring immune receptor (e.g., CAR and/or recombinant TCR) of the disclosure and/or an NF-κB stimulatory molecule of the disclosure such that the disease is treated in the subject. In one aspect the method comprises administering to the subject a cell expressing its endogenous (or native) TCR and an NF-κB stimulatory molecule of the disclosure such that the disease is treated in the subject. In one aspect, the disease associated with expression of a disease associate antigen as described herein is an infectious disease. In one aspect the infectious disease is disease associated with infection by HIV1, HIV2, HTLV1, Epstein Barr virus (EBV), cytomegalovirus (CMV), adenovirus, adeno-associated virus, BK virus, Human Herpesvirus 6, Human Herpesvirus 8, influenza A virus, influenza B virus parainfluenza virus, avian flu virus, MERS and SARS coronaviruses, Crimean Congo Hemorrhagic fever virus, rhino virus, enterovirus, Dengue virus, West Nile virus, Ebola virus, Marburg virus, Lassa fever virus, zika virus, RSV, measles virus, mumps virus, rhino virus, varicella virus, herpes simplex virus 1 and 2, varicella zoster virus, HIV-1, HTLV1, Hepatitis virus, enterovirus, hepatitis B virus, Hepatitis C virus, Nipah and Rift valley fever viruses, Japanese encephalitis virus, *Mycobacterium tuberculosis*, atypical mycobacteria species, *Pneumocystis jirovecii*, toxoplasmosis, rickettsia, nocardia, aspergillus, mucor, or candida.

In some embodiments, the non-naturally occurring immune receptor (e.g., CAR and/or TCR) specifically binds an HIV antigen. In some embodiments, the HIV antigen is an HIV-1 antigen. In some embodiments, the HIV antigen is an HIV envelope protein or a portion thereof. In some embodiments, the HIV antigen is gp120 or a portion thereof. In some embodiments the HIV antigen is the CD4 binding site on gp120. In some embodiments, the HIV antigen is the CD4-induced binding site on gp120. In some embodiments, the HIV antigen is the N-glycan on gp120. In some embodiments, the HIV antigen is the V2 of gp120. In some embodiments, the HIV antigen is the membrane proximal region on gp41.

The disclosure includes a type of cellular therapy where immune effector cells (e.g., T cells or stem cells that give rise to T cells) are genetically modified to express a CAR or TCR of the disclosure and/or an NF-κB stimulatory molecule and the CAR-expressing T cell or stem cell is infused to a recipient in need thereof. The disclosure also includes a type of cellular therapy where immune effector cells (e.g., T cells or stem cells that give rise to T cells) are genetically modified to express a NF-κB stimulatory molecule and such cells are infused to a recipient in need thereof. The infused cells are able to kill disease associated cells (e.g., tumor cells or virally infected cells) in the recipient. Unlike antibody therapies, the NF-κB activator modified immune effector cells (e.g., T cells, stem cells) are able to replicate in vivo resulting in long-term persistence that can lead to sustained tumor control. In various aspects, the NF-κB activator modified immune effector cells (e.g., T cells or stem cells that can give rise to T cells) administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twentythree months, two years, three years, four years, or five years after administration of the T cell or stem cells to the patient.

The disclosure also includes a type of cellular therapy where stem cells (e.g., hematopoietic stem cell or lymphoid stem cells or embryonic stem cells, or induced pluripotent stem cells) that are capable of giving rise to immune effector cells (e.g., T cells) are modified to express a non-naturally occurring immune receptor (e.g., CAR and/or TCR) of the disclosure and/or an NF-κB stimulatory molecule and are administered to a recipient in need thereof. The administered stem cells give rise to immune effector cells (e.g., T cells) after transplantation into the recipient, which (i.e. the immune effector cells) are able to kill disease associated cells in the recipient. Thus, in various aspects, the immune effector cells (e.g., T cells) that are produced in the patient after administration of CAR/NFκB-activator-expressing stem cells, persist in the patient for at least one week, 2 weeks, 3 weeks, one month, two months, three months, four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twentytwo months, twenty-three months, two years, three years, four years, five years, ten years or twenty years after administration of the T cell or stem cells to the patient. The disclosure also includes a type of cellular therapy where stem cells that are capable of giving rise to immune effector cells (e.g., T cells) are modified to express a non-naturally occurring immune receptor (e.g., CAR and/or TCR) of the disclosure and/or an NF-κB stimulatory molecule and are differentiated in vitro to generate immune effector cells that are infused to a recipient in need thereof. The infused immune effector cells (e.g., T cells) after infusion into the recipient are able to kill disease associated cells in the recipient. Thus, in various aspects, the immune effector cells (e.g., T cells) that are administered to the patient persist in the patient for at least 1 day, 2 days, 3 days, 4 days, 5 days, 6 days, one week, 2 weeks, 3 weeks, one month, two months, three months, four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twentythree months, two years, three years, four years, five years, ten years or twenty years.

The disclosure includes a type of cellular therapy where immune effector cells (e.g., T cells or stem cells that give rise to T cells) are genetically modified to express CARs targeting two or more different antigens in the same cell and such T cell or stem cell is infused to a recipient in need thereof. In an embodiment, at least one of the CARs targets an antigen expressed on the hematopoietic cells. In an embodiment, at least one of the CARs targets an antigen selected from the group of CD19, CD20, CD22, BCMA, CS1, CD138, Lyml, Lym2, CD33 and CD123. In an embodiment, at least one of the CARs targets an antigen expressed on the hematopoietic cells and at least one other CARs targets and antigen expressed on solid tumors. In an embodiment, at least one of the CARs targets an antigen selected from the group of CD19, CD20, CD22, BCMA, CS1, CD138, Lyml, Lym2, CD33 or CD123 and at least one other CAR targets an antigen selected from the group of Mesothelin, Her2, Folate Receptor 1, ROR1, IL13Ra2, AFP, WT1, Ras, NY-ESO-1, DLL3, CD70 and PTK7. In an embodiment, at least one of the CARs is a SIR. In an embodiment, at least one of the CARs is an Ab-TCR. In an embodiment, at least one of the CARs is a SIR and the other CAR is a CD3ε/γ/δ TFP. In an embodiment, at least one of the CARs is a Ab-TCR and the other CAR is a CD3ε/γ/δ TFP. In an embodiment, the cells have impaired expression of at least one of the native TCR chains. The disclosure also includes a type of cellular therapy where immune effector cells (e.g., T cells or stem cells that give rise to T cells) are genetically modified to express CARs targeting two different antigens and an NF-κB stimulatory molecule and such cells are infused to a recipient in need thereof. In embodiment, the cells are autologous while in other embodiments the cells are allogenic. The infused cells are able to kill disease associated cells (e.g., tumor cells or virally infected cells) in the recipient.

With respect to ex vivo immunization, at least one of the following occurs in vitro prior to administering the cell into a mammal: i) expansion of the cells, ii) introducing a nucleic acid encoding a non-naturally occurring immune receptor (e.g., CAR and/or TCR) of the disclosure and/or an NF-κB stimulatory molecule to the cells or iii) cryopreservation of the cells.

Ex vivo procedures are well known in the art and are discussed more fully below. Briefly, cells are isolated from a mammal (e.g., a human) and genetically modified (i.e., transduced or transfected in vitro) with a one or more vectors that express a non-naturally occurring immune receptor (e.g., CAR and/or TCR) of the disclosure and/or an NF-κB stimulatory molecule disclosed herein. The non-naturally occurring immune receptor (e.g., CAR and/or TCR) and NF-κB activator-modified cell can be administered to a mammalian recipient to provide a therapeutic benefit. The mammalian recipient may be a human and the non-naturally occurring immune receptor (e.g., CAR and/or TCR) and NF-κB activator-modified cell can be autologous with respect to the recipient. Alternatively, the cells can be allogeneic, syngeneic or xenogeneic with respect to the recipient.

The procedure for ex vivo expansion of hematopoietic stem and progenitor cells is described in U.S. Pat. No. 5,199,942, incorporated herein by reference, can be applied to the cells of the present invention. Other suitable methods are known in the art, therefore the present invention is not limited to any particular method of ex vivo expansion of the cells. Briefly, ex vivo culture and expansion of immune effector cells (e.g., T cells) comprises: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

Generally, the cells activated and expanded as described herein may be utilized in the treatment and prevention of diseases that arise in individuals who are immunocompromised. In certain aspects, the cells of the disclosure are used in the treatment of patients at risk for developing diseases, disorders and conditions associated with expression of a disease associate antigen as described herein. Thus, the disclosure provides methods for the treatment or prevention of diseases, disorders and conditions associated with expression of a disease associate antigen as described herein comprising administering to a subject in need thereof, a therapeutically effective amount of the CAR/TCR/NF-κB stimulatory molecule-modified immune effector cells (e.g., T cells) or stem cells that are capable of generating immune effector cells of the disclosure.

In one aspect the CAR/TCR/NF-κB stimulatory molecule-expressing cells of the disclosures may be used to treat a proliferative disease such as a cancer or malignancy or is a precancerous condition such as a myelodysplasia, a myelodysplastic syndrome or a preleukemia. Further a disease associated with a cancer associate antigen as described herein expression include, but not limited to, e.g., atypical and/or non-classical cancers, malignancies, precancerous conditions or proliferative diseases expressing a cancer associated antigen as described herein. Noncancer related indications associated with expression of a disease associate antigen as described herein include, but are not limited to, e.g., autoimmune disease, (e.g., lupus), inflammatory disorders (allergy and asthma), infectious conditions (e.g., HIV1, CMV, EBV, influenza) and transplantation.

The CAR/TCR/NF-κB stimulatory molecule-modified immune effector cells (e.g., T cells) of the disclosure may be administered either alone, or as a pharmaceutical composition in combination with diluents and/or with other components such as IL-2 or other cytokines or cell populations.

Hematological cancer or blood cancer conditions are the types of cancer such as leukemia, lymphoma, and malignant lymphoproliferative conditions that affect blood, bone marrow and the lymphatic system.

Leukemia can be classified as acute leukemia and chronic leukemia. Acute leukemia can be further classified as acute myelogenous leukemia (AML) and acute lymphoid leukemia (ALL). Chronic leukemia includes chronic myelogenous leukemia (CML) and chronic lymphoid leukemia (CLL). Other related conditions include myelodysplastic syndromes (MDS, formerly known as "preleukemia") which are a diverse collection of hematological conditions united by ineffective production (or dysplasia) of myeloid blood cells and risk of transformation to AML.

Lymphoma is a group of blood cell tumors that develop from lymphocytes. Exemplary lymphomas include non-Hodgkin lymphoma and Hodgkin lymphoma.

The disclosure provides for compositions and methods for treating and preventing cancer. In one aspect, the cancer is a hematologic cancer or blood cancer including but is not limited to hematological cancer is a leukemia or a lymphoma. In one aspect, the CAR/TCR/NFκB-expressing cells of the disclosure may be used to treat cancers and malignancies such as, but not limited to, e.g., acute leukemias including but not limited to, e.g., B-cell acute lymphoid leukemia ("BALL"), T-cell acute lymphoid leukemia ("TALL"), acute lymphoid leukemia (ALL); one or more chronic leukemias including but not limited to, e.g., chronic myelogenous leukemia (CML), chronic lymphocytic leukemia (CLL); additional hematologic cancers or hematologic conditions including, but not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further a disease associated with a cancer associate antigen as described herein expression includes, but not limited to, e.g., atypical and/or non-classical cancers, malignancies, precancerous conditions or proliferative diseases expressing a cancer associate antigen as described herein.

The disclosure provides a method of administering to a subject an effective amount of a cell, e.g., an immune effector cell, or a population thereof, each cell comprising a non-naturally occurring immune receptor (e.g., CAR and/or TCR) and/or NF-κB stimulatory molecule, optionally in combination with an agent that increases the efficacy and/or safety of the immune cell. In various embodiments, the agent that increases the efficacy and/or safety of the immune cell is selected from the group consisting of (i) a protein phosphatase inhibitor; (ii) a kinase inhibitor; (iii) a cytokine; (iv) an inhibitor of an immune inhibitory molecule; (v) an agent that decreases the level or activity of a TREG cell; (vi) an agent that increase the proliferation and/or persistence of a CAR/NF-κB stimulatory molecule-modified cells; (vii) a chemokine; (viii) an agent that increases the expression of CARs/TCRs; (ix) an agent that allows regulation of the expression or activity of a CAR; (x) an agent that allows control over the survival and/or persistence of the modified cells; (xi) an agent that controls the side effects of the modified cells; (xii) a Brd4 inhibitor; (xiii) an agent that delivers a therapeutic (e.g. sHVEM) or prophylactic agent to the site of the disease; (xiv) an agent that increases the expression of the target antigen against which the CAR is directed; (xv) an adenosine A2a receptor antagonist; and (xvi) any combination of (i)-(xv).

In some embodiments, the disease to be treated or prevented is a hematologic cancer. In further embodiments, the hematologic cancer is leukemia. Non-limiting examples of acute leukemias include B-cell acute lymphoid leukemia ("BALL"), T-cell acute lymphoid leukemia ("TALL"), acute lymphoid leukemia (ALL); one or more chronic leukemias including but not limited to chronic myelogenous leukemia (CML), chronic lymphocytic leukemia (CLL); additional hematologic cancers or hematologic conditions including, but not limited to B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, nonHodgkin lymphoma, Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and to disease associated with expression of a tumor antigen described herein include, but not limited to, atypical and/or non-classical cancers, malignancies, precancerous conditions or proliferative diseases expressing a tumor antigen as described herein; and any combination thereof. In another embodiment, the disease associated with a tumor antigen described herein is a solid tumor.

In some embodiments, the tumor antigen associated with the disease is selected from: CD5, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bD-Galp(1-4)bDG1cp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); FmsLike Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDClalp(1-4)bDG1cp(1-1)Cer); transglutaminase 5 (TGS5); high molecular weight-melanoma associated antigen (HMW-MAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRCSD); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin Bl; v-myc avian myelocytomatosis viral oncogene neuroblastoma derived homolog (MYCN); Ras Homolog Family Member C (RhoC); Tyrosinase-related protein 2 (TRP-2); Cytochrome P4501B 1 (CYP1B 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation End products (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGL11, ALK TCRgamma-delta, NKG2D, CD32 (FCGR2A), CSPG4-HMW-MAA, Tim1–/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Chorionic Gonadotropin Hormone receptor (CGHR), CCR4, SLAMF6, SLAMF4, HIV1 envelope glycoprotein, HTLV1-Tax, CMV pp65, EBV-EBNA3c, influenza A hemagglutinin (HA), GAD, PDL1, Guanylyl cyclase C (GCC), KSHV-K8.1 protein, KSHV-gH protein, auto-anti-body to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2)), P-glycoprotein, STEAP1, LIV1, NECTIN-4, CRIPTO, GPA33, BST1/CD157, low conductance chloride channel, and antigen recognized by TNT antibody.

In some embodiments, the disease to be treated is an infectious disease including, but not limited to, infection by HIV1, HIV2, HTLV1, Epstein Barr virus (EBV), cytomegalovirus (CMV), adenovirus, adeno-associated virus, BK virus, Human Herpesvirus 6, Human Herpesvirus 8 influenza virus, parainfluenza virus, avian flu virus, MERS and SARS coronaviruses, Crimean Congo Hemorrhagic fever virus, rhino virus, enterovirus, Dengue virus, West Nile virus, Ebola virus, Marburg virus, Lassa fever virus, zika virus, RSV, measles virus, mumps virus, rhino virus, varicella virus, herpes simplex virus 1 and 2, varicella zoster virus, HIV-1, HTLV1, Hepatitis virus, enterovirus, hepatitis B virus, Hepatitis C virus, Nipah and Rift valley fever viruses, Japanese encephalitis virus, *Mycobacterium tuberculosis*, atypical mycobacteria species, *Pneumocystis jirovecii*, toxoplasmosis, rickettsia, nocardia, aspergillus, mucor, or candida. In such diseases, the target antigen associated with the disease is selected from: HIV1 envelope glycoprotein, HIV1-gag, HTLV1-Tax, CMV pp65, EBV-EBNA3c, influenza A hemagglutinin (HA) and GAD.

The disease to be treated or prevented by the methods and compositions of the disclosure can be an immune or degenerative disease, e.g., diabetes mellitus, multiple sclerosis, rheumatoid arthritis, pemphigus vulgaris, ankylosing spondylitis, Hoshimoto's thyroiditis, SLE, sarcoidosis, scleroderma, mixed connective tissue disease, graft versus host disease or Alzheimer's disease. In such embodiments, the target antigen associated with the disease is an autoantibody.

Further non-limiting examples of diseases associated with expression of a target antigen include any one of the following cancers or related conditions: colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, combinations of said cancers, and metastatic lesions of said cancers.

In certain embodiments of the methods or uses described herein, the CAR/TCR-expressing cell comprising a non-naturally occurring immune receptor (e.g., CAR and/or TCR) and/or NF-κB stimulatory molecule molecule is administered in combination with an agent that increases the efficacy of the immune effector cell, e.g., one or more of a protein phosphatase inhibitor, a kinase inhibitor, a cytokine, a chemokine, a scFV fragment, a bispecific antibody, an inhibitor of an immune inhibitory molecule; a cellular signaling protein, a viral signaling protein, or an agent that decreases the level or activity of a TREG cell. Non-limiting examples of protein phosphatase inhibitors include a SHP-1 inhibitor and/or an SHP-2 inhibitor. Non-limiting examples of kinase inhibitors include a CDK4 inhibitor, a CDK4/6 inhibitor (e.g., palbociclib), a BTK inhibitor (e.g., ibrutinib or RN-486), an mTOR inhibitor (e.g., rapamycin or everolimus (RAD001)), an MNK inhibitor, or a dual P13K/mTOR inhibitor. In one embodiment, the BTK inhibitor does not reduce or inhibit the kinase activity of interleukin-2-inducible kinase (ITK). Non limiting examples of an A2a receptor antagonist include Vipadenant. In some embodiments, the agent that inhibits the immune inhibitory molecule may be one or more of an antibody or antibody fragment, an inhibitory nucleic acid, a clustered regularly interspaced short palindromic repeats (CRISPR), a transcription-activator like effector nuclease (TALEN), or a zinc finger endonuclease (ZFN) that inhibits the expression of the inhibitory molecule. In other embodiments of the methods or uses described herein, the agent that decreases the level or activity of the TREG cells is chosen from cyclophosphamide, antiGITR antibody, CD25-depletion, or a combination thereof. In certain embodiments of the methods or uses described herein, the immune inhibitory molecule is selected from the group consisting of PD1, PD-L1, CTLA-4, TIM-3, LAG-3, VISTA, BTLA, TIGIT, LAIR1, CD160, 2B4, TGFR beta, CEACAM-1, CEACAM-3, and CEACAM-5. In other embodiments, the cytokine is chosen from IL2, IL-7, IL-15 or IL-21, or any combination thereof. In other embodiments, the immune effector cell comprising the CAR/TCR and/or NF-κB stimulating molecule and a second, e.g., any of the combination therapies disclosed herein (e.g., the agent that that increases the efficacy of the immune effector cell) are administered substantially simultaneously or sequentially. In one embodiment the cytokine is administered to the subject simultaneously (e.g., administered on the same day) with or shortly after administration (e.g., administered 1 day, 2 days, 3 days, 4 days, 5 days, 6 days, or 7 days after administration) of the cell or population of cells comprising a CAR/TCR and/or NF-κB stimulatory molecule. In other embodiments, the cytokine is administered to the subject after a prolonged period of time (e.g., at least 2 weeks, 3 weeks, 4 weeks, 6 weeks, 8 weeks, 10 weeks, or more) after administration of the cell or population of cells, or after assessment of the subject's response to the cell.

In other embodiments, the cells expressing a non-natu-rally occurring immune receptor (e.g., CAR and/or TCR) and/or NF-κB stimulatory molecule are administered in combination with an agent that ameliorates one or more side effects associated with administration of a cell expressing a CAR/TCR and/or NF-κB stimulatory molecule. Side effects associated with the CAR/TCR and/or NF-κB stimulatory molecule)-expressing cell can be chosen from cytokine release syndrome (CRS), hemophagocytic lymphohistiocy-tosis (HLH) or neurological complications. Examples of such agents include steroids (e.g. prednisone, dexametha-sone), IL6R antagonists (e.g., tocilizumab), IL1R antago-nists (e.g., anakinra), src kinase inhibitors (e.g., dasatinib or a water soluble salt of dasatinib), a kinase inhibitor (e.g., Ibrutinib), calcineurin inhibitors (e.g., tacrolimus or cyclosporine A) or chemotherapy drugs (e.g., cyclophosph-amide, methotrexate or vincristine).

In one embodiment, the cells expressing a non-naturally occurring immune receptor (e.g., CAR and/or TCR) and/or NF-κB stimulatory molecule are administered in combina-tion with a low, immune enhancing dose of an mTOR inhibitor. While not wishing to be bound by theory, it is believed that treatment with a low, immune enhancing, dose (e.g., a dose does not completely suppress the immune system but is sufficient to improve immune function) is accompanied by a reduction in PD-1 positive T cells or an increase in PD-1 negative cells. PD-1 positive T cells, but not PD-1 negative T cells, can be exhausted by engagement with cells which express a PD-1 ligand, e.g., PD-L1 or PD-L2.

Pharmaceutical compositions of the disclosure may com-prise a non-naturally occurring immune receptor (e.g., CAR and/or TCR) and/or NF-κB stimulatory molecule expressing cell, e.g., a plurality of CAR/TCR and/or NF-κB stimulatory molecule-expressing cells, as described herein, in combina-tion with one or more pharmaceutically or physiologically acceptable carriers, diluents or excipients. Such composi-tions may comprise buffers such as neutral buffered saline, phosphate buffered saline and the like; carbohydrates such as glucose, mannose, sucrose or dextrans, mannitol; pro-teins; polypeptides or amino acids such as glycine; antioxi-dants; chelating agents such as EDTA or glutathione; adju-vants (e.g., aluminum hydroxide); and preservatives. Compositions of the disclosure can be formulated for intra-venous administration. The composition may further com-prise a secondary active agent (e.g., an anticancer, antiviral or antibiotic agent).

Pharmaceutical compositions of the disclosure may be administered in a manner appropriate to the disease to be treated (or prevented). The quantity and frequency of admin-istration will be determined by such factors as the condition of the patient, and the type and severity of the patient's disease. When "an immunologically effective amount," "an anti-tumor effective amount," "a tumor-inhibiting effective amount," or "therapeutic amount" or "anti-infective" is indicated, the amount of the compositions of the disclosure to be administered can be determined by a physician with consideration of individual differences in age, weight, tumor size, extent of infection or metastasis, and condition of the patient (subject) as the case may be. It can generally be stated that a pharmaceutical composition comprising the immune effector cells (e.g., T cells, NK cells) described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immuno-therapy (see, e.g., Rosenberg et al., New Eng. J. of Med. 319:1676, 1988).

In certain aspects, it may be desired to administer acti-vated immune effector cells (e.g., T cells, NK cells) to a subject and then subsequently redraw blood (or have an apheresis performed), activate immune effector cells (e.g., T cells, NK cells) therefrom according to the disclosure, and reinfuse the patient with these activated and expanded immune effector cells (e.g., T cells, NK cells). This process can be carried out multiple times every few weeks. In certain aspects, immune effector cells (e.g., T cells, NK cells) can be activated from blood draws of from 10 cc to 400 cc. In certain aspects, immune effector cells (e.g., T cells, NK cells) are activated from blood draws of 20 cc, 30 cc, 40 cc, 50 cc, 60 cc, 70 cc, 80 cc, 90 cc, or 100 cc.

In some embodiments, subjects may undergo leukapphere-sis, wherein leukocytes are collected, enriched, or depleted ex vivo to select and/or isolate the cells of interest, e.g., T cells. These T cell isolates may be expanded by methods known in the art and treated and/or transformed such that one or more constructs of the disclosure may be introduced, thereby creating a CAR-T or TCR-T cell of the disclosure coexpressing an accessory module encoding a NF-κB acti-vator. Subjects in need thereof may subsequently undergo standard treatment with high dose chemotherapy followed by peripheral blood stem cell transplantation. In certain aspects, following or concurrent with the transplant, subjects receive an infusion of the expanded CAR-T cells or TCR-T cells of the disclosure that optionally coexpress an accessory module encoding a NF-κB activator. In an additional aspect, expanded cells are administered before or following surgery.

Kits to practice the disclosure are also provided. For example, kits for treating a cancer in a subject, or making a cell that expresses a non-naturally occurring immune recep-tor (e.g., CAR and/or TCR) and/or NF-κB stimulatory molecule disclosed herein. The kits may include at least one nucleic acid molecule or vector encoding a non-naturally occurring immune receptor (e.g., CAR and/or TCR) and/or NF-κB stimulatory molecule along with a method to intro-duce the nucleic acid into the immune effector cells. Th kit may include a virus comprising a nucleic acid encoding a non-naturally occurring immune receptor (e.g., CAR and/or TCR) and/or NF-κB stimulatory molecule and chemicals, such as polybrene, to enhance the virus transduction. The kit may contain components for isolation of T cells for express-ing a non-naturally occurring immune receptor (e.g., CAR and/or TCR). Alternatively, the kit may contain immune effector cells (e.g., T cells or NK cells) or stem cells expressing a non-naturally occurring immune receptor (e.g., CAR and/or TCR) and/or NF-κB stimulatory molecule. More than one of the disclosed non-naturally occurring immune receptor (e.g., CAR and/or TCR) and/or NF-κB stimulatory molecules can be included in the kit. The kit can include a container and a label or package insert on or associated with the container.

Suitable containers include, for example, bottles, vials, syringes, etc. The containers may be formed from a variety of materials such as glass or plastic. The container typically holds a composition including one or more of the nucleic acid molecules, viruses, vectors, T cells etc. In several embodiments the container may have a sterile access port (for example the container may be an intravenous solution bag or a vial having a stopper pierceable by a hypodermic injection needle). A label or package insert indicates that the composition is used for treating the particular condition. The label or package insert typically will further include instructions for use of a disclosed components, for example, in a method of treating or preventing a tumor or of making a CAR-T cell. The package insert typically includes instructions customarily included in commercial packages of therapeutic products that contain information about the indications, usage, dosage, administration, contraindications and/or warnings concerning the use of such therapeutic products. The instructional materials may be written, in an electronic form (such as a computer diskette or compact disk) or may be visual (such as video files). The kits may also include additional components to facilitate the particular application for which the kit is designed. Thus, for example, the kit may additionally contain means for measuring the expression of a CAR and/or NF-κB stimulatory molecule on or in T cells or of determining the number or percentage of T cells that express the CAR and/or NF-κB stimulatory molecule or of determining the functionality of cells. The kits may additionally include buffers and other reagents routinely used for the practice of a particular method. Such kits and appropriate contents are well known to those of skill in the art.

The disclosure is further described by reference to the following experimental examples. These examples are provided for purposes of illustration only, and are not intended to be limiting unless otherwise specified. Thus, the disclosure should in no way be construed as being limited to the following examples, but rather, should be construed to encompass any and all variations which become evident as a result of the teaching provided herein.

EXAMPLES

Cell lines engineered to express luciferases (e.g., GLuc or NLuc) for measuring cytotoxicity of different constructs targeting different cell surface and intracellular antigens are provided in Table A. Cell lines used in this experiments, target antigens on the cells lines and their growth media are shown in the following Table A. Cells were cultured at 37° C., in a 5% $CO_2$ humidified incubator. The cell lines were obtained from ATCC, NIH AIDS reagent program or were available in the laboratory.

TABLE A

| Cell line | Culture Conditions | Exemplary CAR Target Antigens Expressed |
|---|---|---|
| BC-1 | RPMI, 20% FCS | BCMA, GPRC, CD138 |
| BC-3 | RPMI, 20% FCS | BCMA, GPRC, CD138 |
| BCBL-1 | RPMI, 20% FCS | GPRC, CD138 |
| JSC-1 | RPMI, 20% FCS | GPRC, CD138 |
| MM1S | RPMI, 10% FCS | CD38, GPRC, CD44, CD200R |
| U266 | RPMI, 10% FCS | BCMA, WT1/HLA-A2+, CS1, CLL1, CD138, c-MET, IL6R, CD179b, NY-ESO/HLA-A2, NYBR, LAMP1 |
| L363 | RPMI, 10% FCS | BCMA, GPRC, WT1/HLA-A2+, CS1, CLL1, CD138, NY-ESO/HLA-A2, NYBR, LAMP1 |
| K562 | RPMI, 10% FCS | CD33, IL1Ra, TnAg |
| BV173 | RPMI, 10% FCS | CD123, CD179b, IL1Ra, WT1/HLA-A2+, CXCR4, FLT3, CD179a |
| Nalm6 | RPMI, 10% FCS | CD19, CD20, CD22, CD179b, CD179a |
| HL60 | RPMI, 10% FCS | CD33, CD34, CLL1, IL6R, CD32, CD179 |
| U937 | RPMI, 10% FCS | CD4, CLL1 |
| RS:411 | RPMI, 20% FCS | CD19, Folate Receptor beta (FRbeta), TGFbeta, CD179b, NKG2DNKG2D, FLT3, CD179a |
| MV:411 | RPMI, 10% FCS | FLT3, CD123, FRbeta |
| Raji | RPMI, 10% FCS | CD19, CD20, CD22, BCMA, CD38, CD70, CD79, Folate Receptor beta, CLL1 |
| HEL-92.1.7 (HEL) | RPMI, 10% FCS | MPL, CD33, CD32, CD200R |
| Jurkat | RPMI, 10% FCS | TnAg, TSLRP, TSHR, CD4, CD38 |
| Daudi | RPMI, 10% FCS | BCMA, FRbeta |
| REC-1 | RPMI, 10% FCS | NKG2DNKG2D, ROR1 |
| KG-1 | RPMI, 20% FCS | CD33, CD34, CD123, TSLRP |
| CEM | RPMI, 10% FCS | CD5, CD43 |
| U937 | RPMI, 10% FCS | CD4, CLL1 |
| LAMA5 | RPMI, 10% FCS | WT1/HLA-A2 |
| A549 | DMEM, 10% FCS | ROR1, CD22, TIM1, CDH17 |
| HT29 | DMEM, 10% FCS | EGFR, SLEA, c-MET |
| Molm-13 | RPMI, 20% FCS | FLT3, IL6R, LAMP1, TSLRP, CD4, CSF2RA, CXCR4, IL6R, CSF2RA, GPC3 |
| A431 | DMEM, 10% FCS | EGFR, Folate Receptor Alpha, Her3 |
| P19 | DMEM, 10% FCS | SSEA |
| THP-1 | RPMI, 10% FCS | CD32, CD33, CXCR4, CD123, CD44, IL6R, Folate Receptor beta, CD70, LAMP1, FLT3, CSF2RA |
| U87MG | DMEM, 10% FCS | CD276, gpNMB, IL13RA2 |
| LoVo | DMEM, 10% FCS | Tissue Factor, CDH17, EGFR |
| SKOV-3 | DMEM, 10% FCS | Folate Receptor alpha (FR1), FSHR, Her2, Her3, LHR, MSLN, TIM1, EPCAM |
| NCI-H1993 | DMEM, 10% FCS | EGFR |

TABLE A-continued

| Cell line | Culture Conditions | Exemplary CAR Target Antigens Expressed |
|---|---|---|
| Kasumi-1 | RPMI, 20% FCS | CLEC5A, PR1/HLA-A2, TGFbeta, |
| Jeko-1 | RPMI, 20% FCS | BCMA, ROR1 |
| PC-3 | DMEM, 10% FCS | CGH, TROP2, PSCA, PSMA. EPCAM, FSHR, CLD18A2 (CLDN18.2) |
| HeLa | DMEM, 10% FCS | EGFR, FR1, MSLN, TSHR |
| LnCap | DMEM, 10% FCS | EGFR, FSHR, PSCA, PSMA, CD22, Her3, CD22, LHR, CLD18A2 (CLDN18.2) |
| OVCAR-3 | DMEM, 10% FCS | B7H4, CDH6, DLL3, FR1, FSH, LHR, MSLN, PTK7, TnAg, TSHR, L1CAM |
| MEL-624 | DMEM, 10% FCS | CDH19, GD2, GD3, gp100/HLA-A2, gpNMB, HMWMAA, NYESO/HLA-A2, MART1/HLA-A2 |
| LS174-T | DMEM, 10% FCS | CEA |
| MEL-526 | DMEM, 10% FCS | GD2 |
| MDA-MB231 | DMEM, 10% FCS | CD324, Muc1 |
| L1236 | RPMI, 20% FCS | CD30, CD23, PDL1 |
| L428 | RPMI, 20% FCS | CD30, CD123, CCR4, PDL1 |
| L540 | RPMI, 20% FCS | CD30, CCR4, PDL1 |
| Molt-16 | RPMI, 20% FCS | IL1ra, NKG2DNKG2D |
| CEM | RPMI, 10% FCS | CD5 |
| MG-63 | DMEM, 10% FCS | IL13RA2 |
| Karpass-299 | RPMI, 20% FCS | Alk, GPRC, PDL1 |
| MCF7 | DMEM, 10% FCS | B7D4, CD276, TROP2, Her3, Muc1, LewisY, LHR |
| AA-2 | RPMI, 10% FCS | HIV1 env glycoprotein (gp120) |
| HL2/3 | DMEM, 10% FCS | HIV1 env glycoprotein (gp120) |
| TF228.1.16 | DMEM, 10% FCS | HIV1 env glycoprotein (gp120), CCR4 |
| TT | DMEM, 10% FCS | TGF-Beta, TSHR, GFRalpha4 |
| DMS79 | RPMI, 10% FCS | Fucosyl-GM1, Slea (CA19.9; Sialyl Lewis Antigen) |
| LAN-5 | DMEM, 10% FCS | ALK, DLL3, GFRalpha4, FUCOSYL-GM1 |
| PEER1 | RPMI, 10% FCS | TSHR |
| SK-MEL-37 | DMEM, 10% FCS | DLL3, GD2 |
| F9 | DMEM, 10% FCS | SSEA |
| HepG2 | DMEM, 10% FBS | GPC3, AFP/HLA-A2 |

Jurkat cell line (clone E6-1) engineered with a NFAT-dependent EGFP (or GFP) reporter gene was a gift from Dr. Arthur Weiss at University of California San Francisco and have been described to study CAR-signaling ((Wu, C Y et al., Science 350:293-302, 2015). Jurkat cells were maintained in RPMI-1640 medium supplemented with 10% FBS, penicillin and streptomycin.

Generation of Lentiviral Vectors Encoding Chimeric Antigen Receptors Against MPL The pLENTI-Blast vector was derived from pLenti6v5gw_lacz vector (Invitrogen; ThermoFisher Scientific) by removal of the LacZ gene. pLenti-MP2 was a gift from Pantelis Tsoulfas (Addgene plasmid #36097) and was used to generate pLenti-EF1α or pLenti-EF1α [SEQ ID NO:3837] lentiviral vector by replacement of the CMV promoter with human EF1α promoter using standard molecular biology techniques. pLenti-EF1a-DWPRE [SEQ ID NO:3838] was derived from the pLENTI-EF1α vector by deletion of WPRE sequence. An internal Sac II fragment was deleted from the EF1α promoter to generate EF1alpha (EF1a)-D-SACII-Promoter (SEQ ID NO: 3842). The psPAX2 vector was a gift from Didier Trono (Addgene plasmid #12260). The pLP/VSVG envelope plasmid and 293FT cells were obtained from Invitrogen (ThermoFisher Scientific). The retroviral transfer vector MSCVneo, MSCVhygro, and MSCVpac and the packaging vector pKAT were obtained from Dr. Robert Illaria's laboratory. phRGTK Renilla Luciferase plasmid was from Promega.

The generation of Chimeric antigen receptor containing vectors with BBz, CD28z and z-K13 backbones, the generation and use of GGS-NLuc fusion proteins, and the generation and use of luciferase (e.g., GLuc) reporter cell lines for measurement of cellular cytotoxicity using the Matador assays have been described (PCT/US2017/024843, PCT/US2017/025602 and PCT/US2017/052344).

Lentivirus and Retrovirus Vectors

Lentiviruses were generated by calcium phosphate based transfection in 293FT cells essentially as described previously (Matta H et al, Cancer biology and therapy. 2(2):206-10. 2003). 293FT cells were grown in DMEM with 10% FCS 4 mM L-Glutamine, 0.1 mM MEM Non-Essential Amino Acids, and 1 mM MEM Sodium Pyruvate (hereby referred to as DMEM-10). For generation of lentivirus, 293FT cells were plated in 10 ml of DMEM-10 medium without antibiotics in a 10 cm tissue culture plate so that they will be approximately 80 confluent on the day of transfection. The following day, the cells were transfected by calcium phosphate transfection method using 10 μg of lentiviral expression plasmid encoding different genes, 7.5 μg of PSPAX2 plasmid and 2 μg of PLP/VSVG plasmid. Approximately 15-16 hours post-transfection, 9 ml of media was removed and replaced with 5 ml of fresh media. Approximately, 48 hours post-transfection, 5 ml of supernatant was collected (first collection) and replaced with fresh 5 ml media. Approximately 72 hrs post-transfection, all media was collected (second collection, usually around 6 ml). The collected supernatants were pooled and centrifuged at 1000 rpm for 1 minute to remove any cell debris and non-adherent cells. The cell-free supernatant was filtered through 0.45 μm syringe filter. In some cases, the supernatant was further concentrated by ultra-centrifugation at 18500 rpm for 2 hours at 4° C. The viral pellet was re-suspended in 1/10 of the initial volume in XVIVO medium.

The virus was either used fresh to infect the target cells or stored frozen in aliquots at −80° C.

Infection of T Cells and PBMC

Buffy coat cells were obtained from healthy de-identified adult donors from the Blood Bank at Children Hospital of Los Angeles and used to isolate peripheral blood mononuclear cells (PBMC) by Ficoll-Hypaque gradient centrifugation. PBMC were either used as such or used to isolate T cells using CD3 magnetic microbeads (Miltenyi Biotech) and following the manufacturer's instructions. PBMC or isolated T cells were re-suspended in XVIVO medium (Lonza) supplanted with 10 ng/ml CD3 antibody, 10 ng/ml CD28 antibody and 100 IU recombinant human-IL2. Cells were cultured at 37° C., in a 5% CO2 humidified incubator. Cells were activated in the above medium for 1 day prior to infection with lentiviral vectors. In general, primary cells (e.g. T cells) were infected in the morning using spin-infection (1800 rpm for 90 minutes at 37° C. with 300 µl of concentrated virus that had been re-suspended in XVIVO medium in the presence of 8 µg/ml of Polybrene® (Sigma, Catalog no. H9268). The media was changed in the evening and the infection was repeated for two more days for a total of 3 infections. After the 3rd infection, the cells were pelleted and resuspended in fresh XVIVO media containing 10 ng/ml CD3 antibody, 10 ng/ml CD28 antibody and 100 IU recombinant human-IL2 and supplemented with respective antibiotics (if indicated) and place in the cell culture flask for selection, unless indicated otherwise. Cells were cultured in the above medium for 10-15 days in case no drug selection was used and for 20-30 days in case drug-selection was used. In cases, where cells were infected with a lentivirus expressing EGFP, they were expanded without drug-selection or flow-sorted to enrich for EGFP-expressing cells. For infection of cancer cell lines, approximately 500,000 cells were infected with 2 ml of the un-concentrated viral supernatant in a total volume of 3 ml with Polybrene® (Sigma, Catalog no. H9268). Then next morning, the cells were pelleted and resuspended in the media with respective antibiotics and place in the cell culture flask for selection.

Essentially a similar procedure as described above for lentivirus vector production was used for generation of retroviral vectors with the exception that 293FT cells were generally transfected in 10 cm tissue culture plates in 10 ml of DMEM-10 medium using 10 µg of retroviral construct, 4 µg of pKAT and 2 µg of VSVG plasmid. The virus collection and infection of target cells was carried out essentially as described above for lentiviral vectors.

Antibodies and Drugs

Blinatumomab was obtained from Amgen. Digitonin was purchased from Sigma (Cat. no D141) and a stock solution of 100 mg/ml was made in DMSO. A diluted stock of 1 mg/ml was made in PBS. Final concentration of digitonin used for cell lysis was 30 µg/ml unless indicated otherwise.

ELISA

Human IL2, IFNγ, IL6 and TNFα were measured in the cell culture supernatant of CAR-expressing Jurkat-NFAT-GFP effector cells or T cells that had been co-cultured with the specific target cell lines for 24 to 96 hours using commercially available ELISA kits from R&D systems (Minneapolis, MN) and BD Biosciences and following the recommendations of the manufacturer.

FACS Analysis for Detecting Expression of CAR

Mouse Anti-Human c-Myc APC-conjugated Monoclonal Antibody (Catalog #IC3696A) was from R&D Systems (Minneapolis, MN). Biotinylated protein L was purchased from GeneScript (Piscataway, NJ), reconstituted in phosphate buffered saline (PBS) at 1 mg/ml and stored at 4° C. Streptavidin-APC (SA1005) was purchased from ThermoFisher Scientific.

For detection of CARs using Myc staining, $1 \times 10^6$ cells were harvested and washed three times with 3 ml of ice-cold 1×PBS containing 4% bovine serum albumin (BSA) wash buffer. After wash, cells were resuspended in 0.1 ml of the ice-cold wash buffer containing 10 µl of APC-conjugated Myc antibody and incubated in dark for 1 hour followed by two washings with ice cold wash buffer.

For detection of CARs using Protein L staining, $1 \times 10^6$ cells were harvested and washed three times with 3 ml of ice-cold 1×PBS containing 4% bovine serum albumin (BSA) wash buffer. After wash, cells were resuspended in 0.1 ml of the ice-cold wash buffer containing 1 µg of protein L at 4° C. for 1 hour. Cells were washed three times with ice-cold wash buffer, and then incubated (in the dark) with 10 µl of APC-conjugated streptavidin in 0.1 ml of the wash buffer for 30 minutes followed by two washings with ice cold wash buffer. FACS was done using FACSVerse analyzer from BD Biosciences.

Cell Death Assay

To measure cell death, a novel assay based on ectopic cytosolic expression of Gluc, NLuc and other luciferases was utilized as described in PCT/US2017/052344 "A Non-Radioactive Cytotoxicity Assay". The method involves expression of a reporter in a target cells in a manner so that it is preferentially retained within the healthy cells but is either released from dead and dying cells or whose activity can be preferentially measured in dead and dying cells. The preferred reporter for this assay are 1) non-secreted forms of luciferases from the copepods, such as Gaussia princeps, 2) engineered luciferase reporters from deep sea shrimp, such as NanoLuc. The sequence of several such exemplary reporter vectors is provided in SEQ ID NO: 3845 to SEQ ID NO: 3851. The above vectors were used to generate retrovirus and lentiviruses which in turn were used to generate polyclonal population of several target cell lines stably expressing GLuc, NLuc, or TurboLuc following selection with appropriate antibiotics. Unless indicated otherwise, the target cells stably expressing the different luciferases were plated in triplicate in a 384 well plate in the media used for growing the target cells. Target cells which grow in suspension were generally plated at a concentration of $2-3 \times 10^4$ per well, while target cells which grow as adherent monolayers were plated at a concentration of $1-2 \times 10^4$ per well. Unless indicated otherwise, the target cells were cocultured with the genetically modified T cells (i.e. those expressing CAR) at an Effector: Target (E:T) ratio varying from 1:1 to 10:1 for 4 hours to 96 hours. In the case target cells grow as adherent cells (e.g., HeLa cells), they were allowed to attach to the bottom of the wells overnight before the T cells were added. T cells mediated induction of lysis of target cells was assayed by increase of luciferase activity as measured by BioTek synergy plate reader by directly injecting 0.5×CTZ assay buffer containing native coeloentrazine (Nanaolight) as described below.

CTZ Assay

A 100× stock solution of native coelenterazine (CTZ; Nanolight, cat #303) was made by dissolving 1 mg of lyophilized CTZ powder in 1.1 ml of 100% Methanol supplemented with 30 µl of 6N HCl to avoid oxidation of CTZ with time. To make CTZ assay buffer, the 100× stock solution of CTZ was diluted to 0.5× concentration in PBS. Unless indicated otherwise, a total volume of 15 µl of the CTZ assay buffer (as prepared above) was added to each well of a 384-well white plate (Greiner, 384 well white plate cat #781075) containing cells expressing the non-secretory form of the luciferase in approximately 50-60 µl volume of medium and plates were read for luminescence using BioTek synergyH4 plate reader. For 96 well plates, cells were plated in 200 µl of media and approximately 50 µl of 0.5×CTZ assay buffer was added. Unless indicated otherwise, the 0.5×CTZ assay buffer was used for assaying the activity of GLuc, TurboLuc16, and MLuc7. The CTZ assay buffer (diluted to 0.125× concentration) was also used for measurement of NLuc activity in some experiments. In general, unless indicated otherwise, the volume of 0.5×CTZ assay buffer added was approximately ¼th of the volume of the liquid in the well containing the cells, although the assay also worked when the 0.5×CTZ assay was added to the media containing the cells in 1:1 volume. Gluc activity in wells containing media alone (Med) and in wells in which target cells were incubated with T cells that were not infected with any CAR construct (T-UI) were used as controls, where indicated.

Assay to Detect the Expression of Antigens on Target Cells and to Determine the Antigen Binding Activity of Various of Antigen Binding Moieties Used in the Construction of the CARs and BiTes The expression of antigens on target cells was determined by bioinformatics approaches in combination with immunostaining with antigen specific antibodies or a highly sensitive antigen detection assay as described in PCT/US2017/025602 and incorporated herein in its entirety by reference. This assay involves the fusion of a GLuc or NLuc reporter fragment tot the antigen binding domain of an antibody, a scFv, a vHH or any other antigen binding fragment or any receptor and ligand. The resulting fusion protein is incubated with the target cells expressing the test antigen and the binding of the fusion protein is determined by addition of coelentrazine or other suitable substrate of the luciferase reporter.

Generation of a Diverse Pool of CAR T Cells

The above assays were used to screen the different antigen binding modules (e.g. scFv, vHH, receptors, ligands) used in the construction of the CARs of this invention and the antigen binding modules that were found to show specific binding activity were selected for construction of the CARs. Furthermore, some of the scFV fragments were also selected based on their known activity in the literature or in our laboratory.

It is possible that different CARs or subset of CARs are optimally suited for different disease conditions depending on various factors including, but not limited to, the prevelance and level of expression of the target antigen on disease causing and disease-associated cells, disease burden and rate of progression of the disease. Different CARs may be optimally suited even for a single disease condition in different patients depending on their efficacy and toxicity profile and the condition of the patient. The disclosure provides a solution to the significant technical and logistical hurdles to generating a diverse adoptive immune response.

Normal TCR diversity is produced by gene rearrangement. Rigorous positive and negative selection processes in the thymus ensure that only T cells expressing the αβ TCR that are restricted to recognizing self-peptides/MHC within a low affinity range can populate the periphery. Thus, the thymic environment allows the generation of a pool of αβ T cells that are self-restricted, but not self-reactive.

Generating a diverse pool of CAR-T cells from different antigen binding domains is limited by the technical and financial hurdles of generating and testing multiple antigen binding domains. More importantly, as each of the antigen binding domains (e.g., vL and vH fragments of an antibody) has a potential of binding other antigens and causing off-target toxicity, a diverse pool of CARs based only on a plurality of antigen binding domains potentially has an increased risk of toxicity. Therefore, the potential diversity of such a pool would have to be limited to reduce off-target toxicity. The current disclosure overcomes this problem by generating a diverse pool of CARs from a single or a few antigen binding domains by attaching them to different variants of TCR chains, signaling domains and backbones. The diversity of the CARs pool is further increased by the use of different linkers. The diversity of T cells expressing the pool can be further increased by use of different accessory modules described in the disclosure.

This diverse pool of CARs can be used to provide a diverse immune response against disease causing or disease associated cells expressing the said antigen. Alternatively, the diverse pool of CARs can be optionally DNA barcoded using techniques known the art and subsequently used to select a single or a subgroup of CARs with optimal biological and clinical characteristics. These characteristics may include but are not limited to, performance in the in vitro biological assays (e.g., cytotoxicity, cytokine secretion, binding affinity, cell surface expression, off-target effects, T cell proliferation, expression of exhaustion markers and terminal differentiation etc.), performance in the in vivo assays (e.g., survival, tumor reduction, T cell persistence, T cell expansion etc.) and clinical experience (e.g., disease remission, relapse rate, toxicities, etc.). The CARs of the disclosure can be used singly or in combination with other CARs and other natural and synthetic immune receptors known in the art to generate a diverse pool of immune effector cells for the prevention and treatment of various disease conditions caused by or associated with cells expressing their target antigens.

Use of in vitro and vivo selection to select CARs with desired properties. A pool of CARs targeting CD19 (SEQ ID NO: 1594-1608, 1016-1026, 1900-1910) are targeted to the TRAC locus in T cells using TRAC gRNA and techniques known in the art. The targeting vector also carry DNA barcodes located downstream of the stop codon of the CAR inserts. T cells can be derived from peripheral blood. In an alternate embodiment, T cells are derived from a single clone of iPSC or hematopoietic stem cells using techniques known in the art. T cells expressing the pool of CARs are co-cultured with RAJI cells in vitro for 1 to 21 days. Aliquotes of the CAR-T cell pools are collected before the culture with the target cells and on different days after co-culture. Samples are subjected to next generation sequencing to determine the relative frequency of different CARs following exposure to the target cells. Bioinformatics analyses is used to determine the CARs that are associated with better proliferative response following co-culture with the target cells. Essentially a similar approach is used to determine the CARs that confer higher proliferative potential on T cells in vivo and/or persist long term in vivo and/or are present at higher frequency when normalized for their frequency in the starting T cell population in surviving animals as compared to animals that succumb to tumor challenge. In alternate embodiment of the disclosure, essentially a similar approach is used on human clinical samples to identify CARs that are associated with different properties and/or outcomes including but not limited to better long term survival, lower incidence of cytokine release syndrome, lower neurotoxicity and/or higher long term persistence. Such CARs can be subsequently used, either singly or in various combinations, to develop different CARs subpools, containing CARs targeting the same or different antigen binding domains, with diverse properties for the treatment of different disease conditions and different patients. In other enablements, the CAR-T cells are exposed to their target cell line and then sorted into different sets based on the degree of intracellular IFNγ as determined by flow cytometry. The frequency of different CARs in the low vs high IFNγ population is determined by next generation sequencing and normalized to their frequency in the control CAR-T cell population, i.e., CAR-T cells that have not been exposed to the target cell line or are exposed to a cell line that does not express the targe of CARs. From this analysis, CARs that are associated with different levels of IFNγ production can be determined. A similar approach is used to screen for and select CARs with any or a combination of desired properties or attributes including but not limited to, lower expression of exhaustion markers, lower expression of markers of terminal differentiation and/or higher expression of markers of cytotoxicity.

Use of MEMO-Mutants to Provide Costimulation

The mouse NEMO-K270A (SEQ ID NO: 992) is known to activate NF-κB constitutively. To demonstrate the ability of this mutant to provide costimulation to T cells, CD3+ve T cells were cultured in XVIVO medium (Lonza) supplanted with 10 ng/ml soluble anti-CD3, 10 ng/ml soluble anti-CD28 and 100 IU recombinant human-IL2. Cells were cultured at 37° C., in a 5% CO2 humidified incubator, and after 1 day infected with a lentiviral vector (pLENTI-EGFP-Blasticidin) expressing EGFP and lentiviral vectors expressing mouse NEMO-K270A mutants (pLENTI-mNEMO-K270A-FLAG-Blasticidin and pLENTI-mNEMO-K270A-HA-Blasticidin), or mouse NEMO-wt (pLENTI-mNEMO-FLAG-Blasticidin). The sequences of mNEMO-K270A and mNEMO-wt are provided in SEQ ID NOs: 992 and 991, respectively. Approximately 1 day post-infection, cells were selected with blasticidin and cell numbers calculated periodically. T cells infected with lentiviruses encoding the mouse NEMO-K270A mutants (pLENTI-mNEMO-K270A-FLAG-Blasticidin and pLENTI-mNEMO-K270A-HA-Blasticidin) were shown to proliferate more vigorously as compared to T cells infected with lentiviruses encoding EGFP or mouse NEMO-wt (pLENTI-mNEMO-FLAG-Blasticidin).

Figure 3:
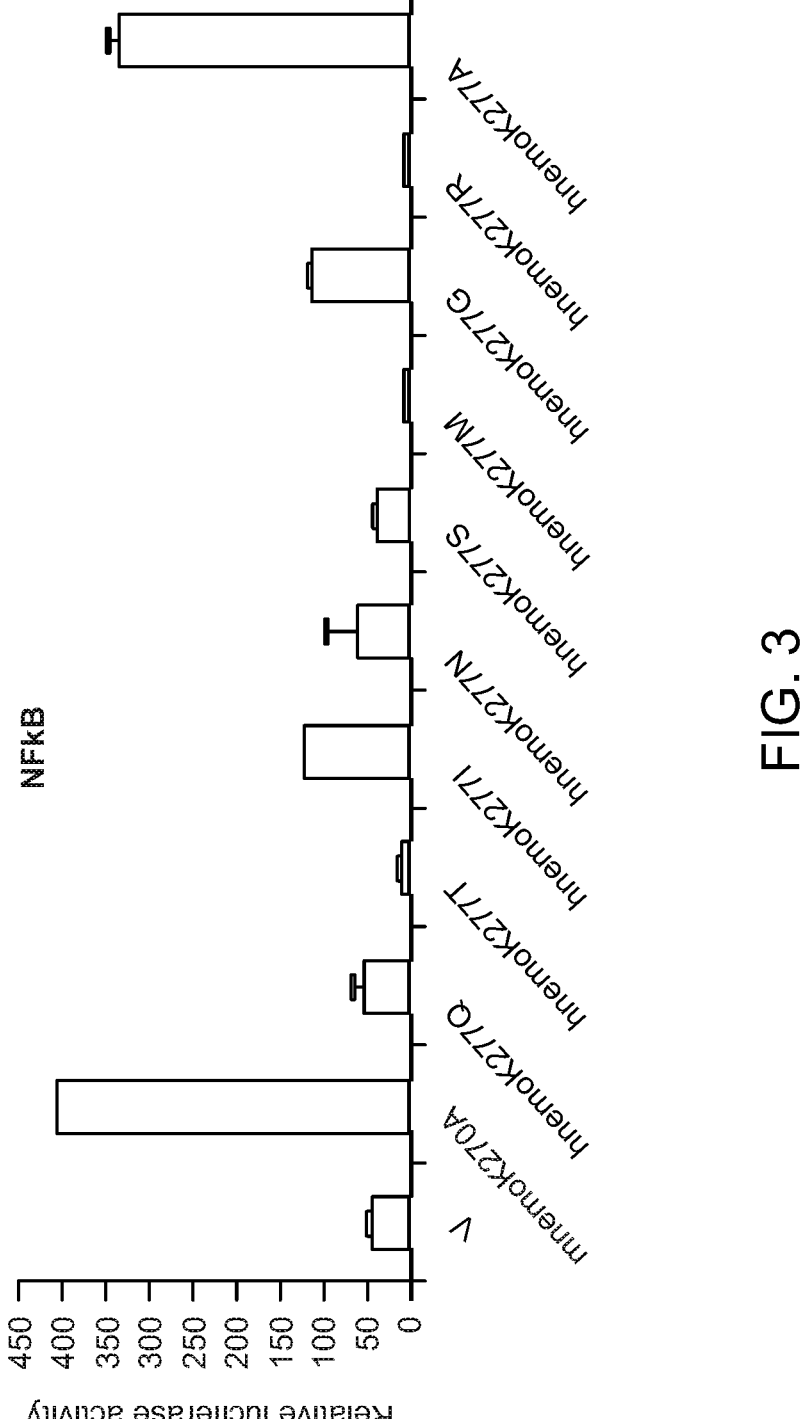
FIG. 3 shows strong activation of NF-κB by mNEMO-K270A, hNEMO-K277A and weak activation by hNEMO-K2771 and hNEMO-K277G mutant.

The human NEMO is longer than mouse NEMO and human NEMO-K277A (hNEMO-K277A; SEQ ID NO: 979) mutant corresponds to mouse NEMO-K270A (mNEMO-K270A) mutant. To test whether hNEMO-K277A mutant also activates NF-κB, expression vector (pCDNA3) encoding this mutant were generated. In addition, expression constructs encoding several other mutants of hNEMO in which Lys (K) at amino acid residue 277 was replaced by different amino acid residues (e.g., K277Q, K277T, K277I, K277N, K277S, K277M, K277G, K277R were generated). The different constructs were transfected in 293FT cells along with an NF-κB-Luciferase reporeter construct and a RSV-LacZ (normalization control) reporter construct and tested for their ability to activate NF-κB using assay described previously. FIG. 3 shows strong activation of NF-κB by mNEMO-K270A, hNEMO-K277A and weak activation by hNEMO-K277I and hNEMO-K277G mutant. In a similar experiment, the hNEMO-K277L and hNEMO-K277A-DeltaV249-K255 mutants also showed NF-κB activation when transfected into 293FT cells. The hNEMO-K277A-DeltaV249-K255 mutant lacks the aminoacid residues V249-K255 of human NEMO and also carries the K277A mutation. These results suggest that constitutive active mutants of NEMO can be rapidly generated and identified by mutating mouse NEMO K270 residue and human NEMO K277 residue. A similar approach can be used to generate mutants at other NEMO residues that have the ability to activate NF-κB.

FMC63 based CD19 CAR CAR construct were generated that coexpressed wither full length hNEMO-K277A or hNEMO-L753 mutant (encoding amino acids 1-251) in fusion with an N-terminal FKBPx2 dimerizer domain. The constructs were transfected into 293FT cells along with an NF-κB-Luciferase reporeter construct and a RSV-LacZ reporter construct. Approximately 8 hours, post-transfection, cells were left untreated or treated with AP20187 (100 nM). After approximately 72 hours, cell lysates were prepared and analyzed for NF-κB luciferase and LacZ activities as described previously. NF-κB-Luc activity was normalized for LacZ activity to control for difference in transfection efficiency. Results showed that treatment with AP20187 led to increase in NF-κB activity in 293FT cells transfected with CAR encoding constructs co-expressing both FKBPx2-hNEMO-K277A (SEQ ID NO: 1006) and FKBPx2-hNEMO-L753 (SEQ ID NO: 1007) mutants. These results demonstrate the ability to activate NF-κB in an inducible manner in a CAR or TCR or chimeric TCR construct by coexpression of full length NEMO or its deletion mutants in fusion with a dimerizer domain followed by addition of a dimerizer.

J-N-G cells are infected with CD19-directed FMC63 based 1st generation CARs coexpressing FKBPx2-hNEMO-K277A or FKBPx2-hNEMO-L753. Cells are cocultured with RAJI target cells in the absence and presence of AP20187 compound and shown to induce EGFP expression, demonstrating that FKBPx2-hNEMO-K277A or FKBPx2-hNEMO-L753 can be co-expressed with a CAR without interfering with its activity.

In addition to NEMO, a number of other cellular proteins are known to activate NF-κB constitutively and can be used in alternate embodiment of the invention to provide costimulation to T cells for the purpose of adoptive cellular therapies. Exemplary proteins include TCL-1A (SEQ ID NO: 1005) and constitutive active mutants of IKKa/IKK1 (IKK1-5176E-S180E; SEQ ID NO: 1004), IKKβ/IKK2 (IKK2-S177E-S181E; SEQ ID NO: 1002) and MYD88-L265P (SEQ ID NO: 1000). In an embodiment embodiment, these proteins are expressed without a dimerizer domain to provide constitutive costimulation to T cells for the purpose of adoptive cellular therapy. These proteins can be expressed in the T cells using any vector (e.g., lentiviral, retroviral, AAV or sleeping beauty transposon vectors) or non-vector (DNA or RNA transfection) method of gene delivery known in the art. Alternatively, these proteins can be expressed by alteration of their genomic copies using techniques of gene altering (e.g., Cas9, Talons, Zn finger nucleases) known in the art. In an exemplary embodiment, one or more genomic copies of hNEMO are mutated to hNEMO-K277A using homologous recombination in T cells using techniques known in the art.

The expression of these costimulatory proteins can be controlled by expressing them using inducible promoters known in the art, such as Tet-inducible promoter or Rheo-Gene system. In an embodiment, hNEMO-K277A mutant and hNEMO-K277A-DeltaV249-K255 are cloned in the pSLIK-Tet-On vector (Gopalakrishnan et al, Clinical Cancer Res; 19(18), 2013) and the resulting virus is used to infect T cells. Treatment of T cells with doxycycline is shown to induce hNEMO-K277A and hNEMO-K277A-DeltaV249-

K255 expression and NF-κB activity. NF-κB activity is measured by AlexaFlour-conjugated Phospho-IκBα antibody and flow cytometry.

In alternate embodiments of the invention, other NF-κB activating proteins or their signaling domains (e.g., IKK1, IKK2, RIP, etc.) are expressed as fusion with a dimerizer domain to provide costimulation to T cells in an inducible manner. The use of these constitutive or inducible NF-κB activating proteins of the invention is not limited to providing costimulation to T cells as they can be used to provide costimulation to other immune cells (e.g., NK cells, dendritic cells, antigen presenting cells etc.) where NF-κB activation is known to enhance their function. As NF-κB is known to protect against apoptosis and promote cell survival, these constitutive and inducible NF-κB activating proteins can be also used in cell engineering to enhance the survival of cells used in biological products manufacturing. In an exemplary embodiment, hybridoma cells are engineered to express hNEMO-K277A, hNEMO-K277A-DeltaV249-K255 (SEQ ID NO: 7769), K13, IKKa/IKK1 (IKK1-SS/EE; SEQ ID NO: 1004), IKKβ/IKK2 (IKK2-S177E-S181E; SEQ ID NO: 1002) or MYD88-L265P (SEQ ID NO: 1000) constitutively to enhance their proliferation and ability to grow at high cell density.

NF-κB Activators for T Cell Adoptive Cell Therapy.

Buffy coat cells are obtained from healthy de-identified adult donors from a Blood Bank and used to isolate peripheral blood mononuclear cells (PBMC) by Ficoll-Hypaque gradient centrifugation. T cells are isolated using CD3 microbeads (Miltenyi), cultured in XVIVO 15 medium supplemented with CD3/CD28 Dynabeads and 50 IU/ml of recombinant IL2. Alternatively, T cells are re-suspended in XVIVO medium (Lonza) supplanted with 10 ng/ml CD3 antibody, 10 ng/ml CD28 antibody and 100 IU recombinant human-IL2.

Next day, T cells are infected with CD19-targeted CARs (including next generation CARs)-encoding lentiviral vectors in the pCCL3-MND3 backbone. The nucleic acid sequences of the CARs are shown in SEQ ID NO: 1016-1029, 1318-1331, 1594-1604, 1900-1913, 2206-2219, 2512-2525, 2818-2831, 3124-3127, 3324-3327. In addition, T cells are infected with CAR constructs corresponding to the above constructs but which lacked the hNEMO-K277A module. For each infection, 18 million T cells are infected with 500 μl of concentrated viruses encoding the different CAR constructs and 8 μg/ml Polybrene by spinfection at 2800 rpm, 32° C. for 90 min in 6-well plates. The plates are incubated at 37° C. for 6 hours. The cells are collected, centrifuged to remove virus and Polybrene, resuspended in fresh culture medium and cultured overnight at 37° C.

Next day, spinfection is repeated and cells are transferred to T-75 cell culture flasks with XVIVO 15 medium supplemented with CD3/CD28 Dynabeads, 50 IU/ml IL2 and 5% FBS.

After 4 days of expansion, CAR-T cells are checked for CAR expression using Protein L staining, CD19-binding, cytokine production (IL2, IFNγ, TNFa) and cytotoxicity (Matador assay).

After 10 days of expansion, the CAR/SIR-T cells are used for in vivo experiment. For this purpose, NSG mice are injected with $10^6$ Nalm-6-Luc cells via tail vein injection. Two days later, $3\times10^6$ CAR/SIR-T cells injected. Mice are imaged weekly by bioluminescence imaging following administration of D-Luciferin and followed for survival.

It is noted that T cells expressing the first generation CARs along with hNEMO-K277A (SEQ ID NO: 1594-1604) show superior IL2 production as measured by ELISA when exposed to RAJI cells as compared to T cells expressing $2^{nd}$ generation CARs (SEQ ID NO: 1594-1604) with a BBz costimulatory domain. In addition, T cells expressing the first generation CARs along with hNEMO-K277A (SEQ ID NO: 1594-1604) show less signs of exhaustion as measured by cell proliferation, cytokine (IL2, IFNγ, TNFα) production, expression of exhaustion markers (e.g., PD1) and cytotoxicity (Matador cytotoxicity assay) when cocultured with RAJI cells over 3 weeks period as compared to T cells expressing $2^{nd}$ generation CARs (SEQ ID NO: 1594-1604) with a BBz costimulatory domain. Finally, T cells expressing the first generation CARs along with hNEMO-K277A (SEQ ID NO: 1594-1604) show superior in vivo activity when administered to NSG mice xenografted with NALM-6-Luc cells as determined by T cells expansion and persistence in vivo, reduction in tumor growth and improved survival. The T cells expressing the first generation CARs along with hNEMO-K277A (Backbone 2; SEQ ID NO: 1594-1604) in general show weaker production of cytokines (e.g., IL2, IFNγ and TNFα) when exposed to RAM cells as compared to T cells expressing first generation CARs and coexpressing vFLIP K13 (i.e., Backbone 1; SEQ ID NO: 1016-1029).

T cells expressing the CAR constructs corresponding to SEQ ID NO: 1900-1913, 2206-2219, 2512-2525, 2818-2831, 3124-3127, 3324-3327 which express hNEMO-K277A show superior in vitro and in vivo activity as compared to the T cells expressing similar constructs but which lack the hNEMO-K277A module. Co-expression of hNEMO-K277A module is also shown to improve the in vitro and in vivo performance of T cells expressing a SIR (SEQ ID NO: 9683) targeting CD20. These results demonstrate that the coexpression of hNEMO-K277A accessory module enhances the in vitro (e.g., proliferation, cytokine production, delay of exhaustion) and in vivo activity (e.g., improved expansion of T cells and anti-tumor activity) of not only the first generation CAR constructs but also of TFP, Ab-TCR and SIRs.

A difference is also noted among the different constructs containing the same backbone but having different antigen binding domains. Thus, among the first generation CAR constructs coexpressing hNEMO-K277A (i.e. Backbone 2) constructs containing the antigen binding domain derived from 4G7 (e.g., SEQ ID NO:1599), huBly3 (e.g., SEQ ID NO: 1604), and huSJ25C1 (e.g., SEQ ID NO: 1605) scFV are generally weaker as compared to constructs containing the antigen binding domain derived from scFv based on FMC63 (e.g., SEQ ID NO: 1594), hu-FMC63-11 (e.g., SEQ ID NO: 1595), huFMC63-11-N203Q (e.g., SEQ ID NO: 1596), Bu12 (e.g., SEQ ID NO: 1597), CD19-MOR0028 (e.g., SEQ ID NO: 1602) and CD19-hu-mROO5 (e.g., SEQ ID NO: 1607). A similar trend is observed in the in vitro and in vivo activity of CARs on other backbones based on the nature of their antigen binding domains.

In the preceding experiments, the hNEMO-K277A module is co-expressed with the CAR module in the T cells using a single vector. The experiment is repeated in which the two modules are expressed using two separate lentiviral vectors. The SEQ ID of nucleic acid construct encoding an exemplary CD20 CAR lacking a hNEMO-K277A module is presented in SEQ ID: 9668. T cells are coinfected with the two lentiviral vectors at multiplicity of infection of 5 and the ratio of the two vectors (i.e. CAR:hNEMO-K277A) is varied from 1:1 to 1:10. The T cells are expanded and tested in the in vitro and in vivo assays. Co-expression of hNEMO-K277A along with a CAR construct is shown to improve the in vitro and in vivo performance of CAR-T cells as determined by assays for IL2 production, cell proliferation, lack of exhaustion, in vivo expansion and anti-tumor activity.

In an alternate embodiment, homologous recombination using gene editing techniques known in the art (e.g., CRISP/Cas9, TALON, Zn finger nucleases etc.) is used to induce the K277A mutation in one or both copies of the endogenous human NEMO gene in T cells. The resulting T cells carrying the hNEMO-K277A mutation are then used for adoptive cellular therapy, including to express the CAR constructs targeting CD19 and TCR constructs targeting NY-ESO-1. The T cells carrying the hNEMO-K277A mutations are shown to show enhanced proliferation, cytokine production, expansion, long term persistence in vivo and anti-tumor activity as compared to control T cells lacking the hNEMO-K277A mutation.

The experiments described in the preceding paragraphs are repeated by using CAR constructs in which the hNEMO-K277A accessory module is replaced by accessory modules encoding FKBPx2-hNEMO, FKBPx2-hNEMO-K277A (SEQ ID NO: 1006), FKBPx2-hNEMO-L753(251) (SEQ ID NO: 1007), FKBPx2-hNEMO-L600(200) (SEQ ID NO: 1008), IKK2-delta-SCD-FKBPv36x2 (SEQ ID NO: 7782), IKK1-delta-SCD-FKBPv36x2 (SEQ ID NO: 7781) and FKBPx2-RIP-ID (SEQ ID NO: 1009). T cells expressing the CAR and these accessory modules are tested using in vitro assays in the absence and presence of the dimerizer AP20187 (100 nM). Addition of AP20187 is shown to induce the proliferation and cytokine production by CAR-T cells expressing the FKBPx2-hNEMO, FKBPx2-hNEMO-K277A (SEQ ID NO: 1006), FKBPx2-hNEMO-L753(251) (SEQ ID NO: 1007), IKK2-delta-SCD-FKBPv36x2 (SEQ ID NO: 7782), IKK1-delta-SCD-FKBPv36x2 (SEQ ID NO: 7781), FKBPx2-hNEMO-L600(200) (SEQ ID NO: 1008) and FKBPx2-RIP-ID (SEQ ID NO: 1009) modules when exposed to target antigen (i.e., CD19) expressing RAJI cells. In an in vivo experiment, NSG mice (n=12 per group) are xenografted with 2 million RAJI-Luc cells by tail vein injection and 3 days later administered 5 million T cells expressing a CD19-CAR and coexpressing the FKBPx2-hNEMO, FKBPx2-hNEMO-K277A (SEQ ID NO: 1006), FKBPx2-hNEMO-L753(251) (SEQ ID NO: 1007), FKBPx2-hNEMO-L600(200) (SEQ ID NO: 1008) and FKBPx2-RIP-ID (SEQ ID NO: 1009) modules. Half the mice in each group (n =6) are administered 40 μg of AP20187 every day for 10 days by intraperitoneal injection as described previously (Chinnery et al, J Immunol 2009; 182:2738-2744). Administration of AP20187 is shown to promote the expansion of CAR-T cells. In an alternate embodiment, the experiment is repeated using constructs in which both the FKBP domains carry the FKBP12V36 mutation which bind to the lipid-permeable dimerizing ligand, Rimiducid, at high affinity. Dimerization of the fusion proteins is brought by administration of rimiducid. For in vitro experiments, Rimiducid is used at final concentration of 10-100 nM. For in vivo studies in NSG mice, Rimiducid is administered weekly by intraperitoneal (i.p) injection at 5 mg/kg.

The experiments described in the preceding paragraphs are repeated by using constructs in which the hNEMO-K277A accessory module is replaced by accessory modules encoding hNEMO-K277A-DeltaV249-K255, IKK2-S177E-S181E, IKK1-S176E-S180E, MYD88-L265P, TCL-1A, and MTCP-1. The CAR-T cells expressing the hNEMO-K277A-DeltaV249-K255, IKK2-S177E-S181E, IKK1-S176E-S180E, MYD88-L265P accessory modules are shown to demonstrate increased cytokine production, proliferation, in vivo expansion and anti-tumor activity as compared to CAR-T cells lacking the accessory module. The CAR-T cells expressing the TCL-1A and MTCP-1 accessory module are shown to have increased proliferative response.

Use of Human NEMO-K277A, Human NEMO-K277A-deltaV249-K255, Mouse NEMO-K270A and IKK2-S177E-S181E in Vaccination Lentiviral vectors are generated expressing human NEMO-K277A, human NEMO-K277A-deltaV249-K255, mouse NEMO-K270A and IKK2-S177E-S181E. Lentiviral vectors are also generating expressing chicken ovalbumin amin acid residues 242-353 and the C terminus of the major histocompatibility complex (MHC) class II invariant chain (Ii-OVA) as described in Rowe H M et al, Molecular Therapy, 13, 2, 2006. Finally, lentiviral vectors are generated coexpressing a cassette encoding human NEMO-K277A, human NEMO-K277A-deltaV249-K255, mouse NEMO-K270A or IKK2-S177E-S181E with a cassette encoding Ii-OVA where the two cassettes are separated by a 2A cleavage sequence.

Transduction of DCs and flow cytometry. Murine bone marrow-derived Dendritic cells (DCs) are prepared as previously described. Immature DCs are transduced on day 4 at an MOT of 20 with lentiviral vectors as described (Rowe H M et al, Molecular Therapy, 13, 2, 2006) and fed every 4 days with fresh medium containing granulocyte-macrophage colony-stimulating factor (50 ng/ml; from Peprotech). On day 5 posttransduction, DCs are harvested, washed, and blocked for Fc receptors before surface staining for maturation markers with the following biotin-conjugated Abs: anti-CD11c, anti-CD86, and anti-I-Ab (MHC class II) (all from BD Pharmingen); anti-CD40 (from Serotec); and anti-CD80, anti-ICAM-1, and anti-Kb (MHC class I) (all from eBioscience). A hamster isotype control Ab (biotin conjugated) is purchased from BD Pharmingen. Abs are then labeled with streptavidin RPE Cy-5 2o reagent (DakoCytomation) before flow cytometry. Lipopolysaccharide (LPS) (50 ng/ml) (Sigma) is added to untransduced DCs and left overnight as a positive control for maturation. Zymosan A (10 μg/ml) treatment (for 30 min at 37° C.) is used as a control for ERK activation.

ELISA. Culture supernatants are harvested from DCs plated at $5 \times 10^5$ cells per well (in 1.5 ml). IL-12p70 and tumor necrosis factor alpha (TNF-α) are detected by sandwich enzyme-linked immunosorbent assay (ELISA), using kits from eBioscience according to the manufacturer's guidelines.

DC purification from lymph nodes. C57/BL6 mice (Harlan) are injected subcutaneously (s.c.) at the base of the tail with $1 \times 10^8$ infectious units (i.u.) lentivector. Six days later, lymph nodes (para-aortical and inguinal) are harvested (cells from mice in each group were pooled), incubated with collagenase CLS-4 (Worthington), and mashed to obtain single-cell suspensions. Fc receptors are blocked before CD11c-positive cells are selected using MACS beads (Miltenyi Biotec).

Pentamer staining. One million splenocytes per sample are incubated with 10 μl of phycoerythrin-conjugated SIINFEKL/Kb pentamer or tetramer (Proimmune) for 12 min at room temperature. The cells are then washed and incubated on ice with biotin-conjugated anti-CD8 (Serotec) for 15 min before being washed and incubated with streptavidin-allophycocyanin (eBioscience) for 15 min. Samples are washed and acquired on a BD LSR machine using Cell-Quest software (BD Biosciences).

Intracellular cytokine staining. Splenocytes are incubated overnight with or without OVA257-264 peptide. Monensin solution (eBiosciences; final concentration, 2 μM) is added and left for 3 h before surface staining cells for CD8. The cells are then fixed and permeabilized using a Cytofix/Cytoperm kit from BD Biosciences. An allophycocyanin-conjugated anti-gamma interferon (anti-IFN-γ) Ab (BD Pharmingen) is then added and left for 30 min before the cells are washed and samples are run on a BD LSR machine.

ELISPOT assay. Enzyme-linked immunospot (ELISPOT) plates (Millipore) are coated overnight at 4° C. with purified anti-IFN-γ (BD Pharmingen). Ex vivo ELISPOT assays is performed with serial dilutions of total splenocytes in triplicate with or without class I OVA257-264 peptide (Proimmune). Plates are cultured overnight and developed according to the manufacturer's directions. Spots are counted using an AID ELISPOT counter and software.

Tumor therapy. EG7.OVA tumor cells are grown in RPMI plus 0.4 mg/ml G418 (Invitrogen). C57BL/6 mice are challenged with $2 \times 10^6$ tumor cells injected s.c. into the flank and then vaccinated. Animals are killed once they had a tumor that reached a diameter of >15 mm.

Mouse BM-derived Dendritic cells (DCs) are infected with the lentivectors encoding human NEMO-K277A, human NEMO-K277A-deltaV249-K255, mouse NEMO-K270A and IKK2-S177E-S181E either alone or in combination with Ii-OVA. Expression of human NEMO-K277A, human NEMO-K277A-deltaV249-K255, mouse NEMO-K270A and IKK2-S177E-S181E is shown to result in nuclear translocation of p65 (RelA) in the nuclei of the DCs at a level similar to that in the LPS-treated DCs but not in the untreated or control vector DCs, in which the level of cytoplasmic p65 is higher. Increased nuclear NF-κB binding activity is also detected in human NEMO-K277A-, human NEMO-K277A-deltaV249-K255-, mouse NEMO-K270A- and IKK2-S177E-S181E-transduced DCs but there is no affect on the activation of the MAPK pathway as determined by nuclear AP1 binding activity.

After transduction of BM-derived DCs with human NEMO-K277A-, human NEMO-K277A-deltaV249-K255-, mouse NEMO-K270A- and IKK2-S177E-S181E, maturation markers on the transduced or nontransduced cells are analyzed. CD86, CD40, ICAM-1, and CD80 are upregulated on human NEMO-K277A-, human NEMO-K277A-deltaV249-K255-, mouse NEMO-K270A- and IKK2-S177E-S181E-expressing DCs compared to transduced DCs in the control vector group. Furthermore, human NEMO-K277A-, human NEMO-K277A-deltaV249-K255-, mouse NEMO-K270A- and IKK2-S177E-S181E-transduced DCs are shown to retain their upregulated CD86 for several weeks in culture. The secretion of IL-12p70 and TNF-α is found to be upregulated in the culture of DCs transduced with human NEMO-K277A-, human NEMO-K277A-deltaV249-K255-, mouse NEMO-K270A- and IKK2-S177E-S181E.

Following s.c. lentivector injection, transduced DCs are detected in the draining lymph nodes. A similar percentage of lymph node DCs (CD11c⁺/MHC class II⁺) are transduced after s.c. injection with either the control or the human NEMO-K277A-, human NEMO-K277A-deltaV249-K255-, mouse NEMO-K270A- and IKK2-S177E-S181E vector. However, there is an upregulation of CD86 on DCs in the human NEMO-K277A-, human NEMO-K277A-deltaV249-K255-, mouse NEMO-K270A- and IKK2-S177E-S181E-injected animals compared to the control vector-injected animals.

The ability of vectors encoding human NEMO-K277A-2A-Ii-OVA, human NEMO-K277A-deltaV249-K255-2A-Ii-OVA, mouse NEMO-K270A-2A-Ii-OVA, IKK2-S177E-S181E-2A-Ii-OVA and Ii-OVA to induce an Ova-specific CD8⁺T-cell response in mice after s.c. vaccination is examined. The vector dose of $5 \times 10^5$ i.u. is used. The human NEMO-K277A-2A-Ii-OVA, human NEMO-K277A-deltaV249-K255-2A-Ii-OVA, mouse NEMO-K270A-2A-Ii-OVA and IKK2-S177E-S181E-2A-Ii-OVA vaccinated mice show SIINFEKL/$K^b$ pentamer-positive CD8⁺ T cells and IFN-γ-secreting CD8⁺ T cells as measured by intracellular fluorescence-activated cell sorting or ELISPOT assay.

Mice are inoculated with a lethal dose of EG7.OVA tumor cells before vaccinating them either with transduced DCs or with the human NEMO-K277A-, human NEMO-K277A-deltaV249-K255-, mouse NEMO-K270A- and IKK2-S177E-S181E-vectors directly. All mice are shown to develop tumors. After either transduced DC injection or direct lentivector injection, the number of tumor-free mice in the human NEMO-K277A-, human NEMO-K277A-deltaV249-K255-, mouse NEMO-K270A- and IKK2-S177E-S181E-group is higher than that in the control group. The efficacy of the NEMO-K277A-2A-Ii-OVA, human NEMO-K277A-deltaV249-K255-2A-Ii-OVA, mouse NEMO-K270A-2A-Ii-OVA, IKK2-S177E-S181E-2A-Ii-OVA vectors is tested in a parasite protection model (Polley R et al, Infect. Immun. 74:773-776, 2016) using L. donovani expressing ovalbumin.

Use of Human NEMO-K277A, Human NEMO-K277A-deltaV249-K255, Mouse NEMO-K270A and IKK2-S177E-S181E in Vaccination Antigen presenting cells collected in a single leukapheresis are transduced with adenoviral vector encoding human NEMO-K277A, human NEMO-K277A-deltaV249-K255, mouse NEMO-K270A and IKK2-S177E-S181E, followed by incubation with protein PA001, which contains the extracellular domain of human prostate-specific membrane antigen. Men with progressive mCRPC following ≤1 prior chemotherapy regimen are enrolled to evaluate three doses of the resulting vaccine ($4 \times 10^6$, $12.5 \times 10^6$ and $25 \times 10^6$ cells) administered intradermally every 2-4 weeks. There are no dose-limiting toxicities. Immune upregulation as well as anti-tumor activity are observed with PSA declines.

Construction and Testing of Humanized MPL CAR Based on scFv Fragment Derived Form 161 Antibody The murine monoclonal antibody 161 targets human MPL (Thrombopoietin receptor o TPO-R). To generate a CAR targeting MPL but with reduced immunogenicity, sequence of the scFV fragment comprising the antigen binding domain of the murine 161 antibody was humanized. The humanized 161 scFv fragment (SEQ ID NO: 891), designated hu-161-2, was cloned in the $2^{nd}$ generation CAR backbone containing the 41BB costimulatory domain and CD3z activation domain (SEQ ID NO: 1582). Jurkat-NFAT-EGFP (J-N-G) cells were stably transduced with the lentivirus encoding the humanized MPL-hu-161-2 CAR construct. The parental and CAR-expressing Jurkats were subsequently cocultured with HEL cells and induction of EGFP expression monitored by FACS analysis after 4 h. Coculturing of Jurkat cells expressing MPL-hu-161-2 CAR construct with HEL cells led to increase in EGFP expression as compared to cells that had not been exposed to HEL cells, indicating the ability of humanized MPL-hu-161-2 CAR construct to recognize the target antigen and activate signaling. Essentially similar results are obtained when the experiment is repeated with a first generation CARs incorporating hu-161-2 scFV and coexpressing either vFLIP K13 (SEQ ID NO: 1286) or hNEMO-K277A mutant (SEQ ID NO: 1878).

Construction and Testing of Humanized MPL CAR Based on scFv Fragment Derived Form 175 and 111 Antibody The murine monoclonals 175 and 111 also bind human MPL. Therefore, the sequence of the scFV fragments comprising the antigen binding domain of these antibody is humanized and used to make the corresponding 2nd generation CAR (CAR II) constructs (SEQ ID NOs: 1583 and 1584) as well as backbones 1 and 2 coexpressing vFLIP K13 (SEQ ID NO: 1287, 1288) and hNEMO-K277A (SEQ ID NOs: 1896 and 1897). The experiment is repeated as in the preceding example. Co-culturing of Jurkat cells expressing MPL-hu-175-2 and hu-111-2 CAR constructs with HEL cells led to increase in EGFP expression as compared to cells that had not been exposed to HEL cells, indicating the ability of humanized MPL-hu-175-2 and hu-111-2 CAR constructs to recognize the target antigen and activate signaling.

Construction and Testing of CARs Targeting CD70

A number of constructs targeting CD70 are constructed (SEQ ID NO: 9781-10086; and 7783-7789). The constructs are expressed in J-N-G and T cells and tested for T cell activation and cytotoxicity against CD70-expressing target cell lines RAJI and THP-1 using in in vitro and in vivo assays.

Construction and Testing of CARs Targeting CD70, PTK7, Kappa Light Chain, Claudin18A2, Ras/HLA-A2 Complex, NY-ESO/HLA-A2 Complex, Streptag and an Epitope of CD43 Expressed on Leukemia Cells.

CAR constructs are generated targeting PTK7, kappa light chain, Claudin18A2, Ras/HLA-A2 complex, NY-ESO/HLA-A2 complex, Streptag and an epitope of CD43 expressed on leukemia cells on either a $2^{nd}$ generation backbone (e.g., conventional CAR II) or backbones 1 and 2 co-expressing either vFLIP K13 or hNEMO-K277A. The experiment is repeated as in the preceding example. Coculturing of Jurkat cells expressing the different CAR constructs with their respective target cells led to increase in EGFP expression as compared to cells that had not been exposed to the target cells. Similarlty, coculturing of T cells expressing the different CAR constructs with their respective target cells expressing GLuc led to increase in cell death as measured by increase in GLuc activity.

TFP Targeting MPL

Several TFP based CARs are constructed targeting MPL based on hu-161-2 scFV as the antigen binding domain. The sequence of these TFP CAR constructs is shown in SEQ ID NO: 3526 to 3533. Jurkat-NFAT-EGFP (J-N-G) cells are transduced with lentiviruses encoding the TFP CARs targeting MPL and selected with puromycin. J-N-G cells expressing the TFP CARs targeting MPL are shown to induce EGFP expression upon co-culture with HEL.92.1.7 (HEL) cells for 4 hours. TFP CARs targeting MPL are also expressed in primary T cells and tested for their ability to induce lysis of HEL-GLuc cells upon co-culture for 4 hours. MPL TFP CAR constructs based on 175, 111, hu-175-2 and hu-111-2 scFv (SEQ ID NO: 10476-10483) are similarly constructed and tested using J-N-G and primary T cells as described above for hu-161-2 based TFP CARs. J TFP Targeting Other Antigens Next TFP CARs targeting a number of different antigens are constructed. In order to provide costimulation, the constructs also coexpress hNEMO-K277A. The constructs are expressed in J-N-G and primary T cells and tested for their ability to recognize cells expressing their target antigen using the assays described above. The TFP CARs expressing J-N-G cells are shown to induce EGFP expression upon co-culture with the target cell expressing their cognate antigen. T cells expressing these TFP CARs targeting different antigens are shown to induce cytotoxicity of the target cells expressing the corresponding antigen using the GLuc based cytotoxicity assay described above. Table A shows the target cell lines expressing the different target antigens that are used in the assay. Additional cell lines expressing the different target antigens are known in the art or can be genetically engineered to express a desired antigen by techniques known in the art. In the above example, the TFP constructs contain an accessory module that co-expresses hNEMO-K277A mutant to provide co-stimulation. In alternate embodiment, TFP constructs are also constructed that either lack an accessory module to provide costimulation or contain an accessory module which provides costimulation through the co-expression of other proteins, such as vFLIP K13. The experiment is repeated as above by expression of the TFP constructs in J-N-G and primary T cells with similar results.

Ab-TCR Targeting MPL

Several Ab-TCR are constructed targeting MPL based on murine 161 scFV as the antigen binding domain. To improve the expression of TCRα and TCRβ based Ab-TCR, specific mutations are introduced in their TCR receptor modules. The sequence of the TCRγ/TCRd, wild-type TCRα/TCRβ (labelled wt-op2) and mutant TCRα/TCRβ (labelled SDVP-IAH) containing Ab-TCR constructs are shown in SEQ ID NO: 959 to 964. Jurkat-NFAT-EGFP (J-N-G) cells are transduced with lentiviruses encoding the Ab-TCRs targeting MPL (SEQ ID NO: 2091, 2397, 2703) and selected with puromycin. J-N-G cells expressing the Ab-TCRs targeting MPL are shown to induce EGFP expression upon co-culture with HEL cells for 4 hours, demonstrating the ability of Ab-TCRs targeting MPL to recognize MPL and activate signaling. Ab-TCRs targeting MPL are also expressed in primary T cells and tested for their ability to induce lysis of HEL-GLuc cells upon co-culture for 4 hours. T cells expressing MPL Ab-TCRs are shown to induce lysis of HEL-GLuc cells as measured by increase in GLuc activity. MPL Ab-TCR constructs based on murine 175 and 111 scFv (SEQ ID NO: 10492-10493) are similarly constructed and tested using J-N-G and primary T cells as described above for 161 based Ab-TCRs.

Ab-TCRs Targeting Other Antigens

Next Ab-TCRs targeting a number of different antigens are constructed. In order to provide costimulation, the constructs also coexpress hNEMO-K277A. The constructs are expressed in J-N-G and primary T cells and tested for their ability to recognize cells expressing their target antigen using the assays described above. The Ab-TCRs expressing J-N-G cells are shown to induce EGFP expression upon co-culture with the target cell expressing their cognate antigen. T cells expressing these Ab-TCRs targeting different antigens are shown to induce cytotoxicity of the target cells expressing the corresponding antigen using the GLuc based cytotoxicity assay described above. Table A shows the target cell lines expressing the different target antigens that are used in the assay. Additional cell lines expressing the different target antigens are known in the art or can be genetically engineered to express a desired antigen by techniques known in the art. In the above example, the Ab-TCR constructs contain an accessory module that co-expresses hNEMO-K277A mutant to provide co-stimulation. In alternate embodiments, Ab-TCR constructs are also constructed that either lack an accessory module to provide costimulation or contain an accessory module which provides costimualtion through the co-expression of other proteins, such as vFLIP K13. The experiment is repeated as above by expression of the Ab-TCR constructs in J-N-G and primary T cells with similar results.

Flow Cytometry for CAR-Mediated Proliferation of Transduced CD8+ T Lymphocytes in Response to HIV-1-Infected Target Cells A number of CARs targeting HIV1 envelop glycoprotein are generated and are represented by SEQ ID NO: 8704-9349. The following assays are used to test their anti-HIV1 activity in vitro. The active constructs are used singly or in combination for the treatment of patients with HIV1 and AIDS.

HIV-1-infected T2 cells, which are MHC class I low due to a deletion in the transporter associated with processing (TAP) (Salter, et al. (1986) EMBO J 5:943-949) and previously shown to be suitable target cells for an HIV-1-specific CAR (Severino, et al. (2003) Virology 306:371-375), served as target cells. These are infected with an excess of HIV-1 NL4-3-based reporter virus containing a gene for murine CD24 (mCD24) in the vpr locus (Ali, et al. (2003) J Virol Methods 110: 137-142) to yield >90% infected cells by 3 or 4 days after infection, as previously described (Bennett, et al. (2007) J Virol 81:4973-4980; Yang, et al. (1996) J Virol 70:5799-5806; and Yang, et al. (1997) J Virol 71:3120-3128). These are irradiated immediately before use with 10,000 rads in a cesium irradiator, as well as peripheral blood mononuclear cells from a healthy donor with 3,000 rads (feeder PBMCs). HIV1-CAR transduced primary CD8+ T lymphocytes are labeled with CellTrace Violet and washed according to manufacturer's directions (ThermoFisher Scientific, Grand Island, NY). In a 48 well plate well, $5 \times 10^5$ labeled transduced cells are added to $5 \times 10^5$ irradiated infected T2 cells and $2 \times 10^6$ irradiated feeder PBMCs, and cultured in 1 ml R10-50 for five days with a medium change after three days. Flow cytometry (LSR Fortessa II cytometer, BD Biosciences) was then performed with co-staining for human CD8 (PerCP-anti-human CD8, catalog #30130, Biolegend, San Diego, CA) and analysis of proliferation using FlowJo software (FlowJo, Ashland, OR). HIV1-CAR-transduced T cells are shown to proliferate when exposed to HIV-1-infected T2 cells.

Virus Suppression Assays

The ability of HIV1-CAR transduced CD8+ T lymphocytes and expanded and enriched clones thereof to suppress the replication of HIV-1 is tested as previously described (Yang, et al. (1997) PNAS USA 94: 11478-11483; and Yang, et al. (1997) J Virol 71:3120-3128). HIV-1 strains tested is obtained from the NIH AIDS Reference and Reagent including 94US_3393 IN (catalog #11250), 90JJS873 (catalog #11251), 96TH_NP1538 (catalog #11252), 00TZ_A246 (catalog #11256). In brief, Tl cells transduced with human CCRS are infected at a multiplicity of 0.1 tissue culture infectious doses per cell, and co-cultured in a 96-well plate with HIV1 CAR-transduced cells at a ratio of $5 \times 10^4$ to $1.25 \times 10^4$ cells respectively in 200 µl of Rl 0-50, or no effector cells as a control. The effector cells are confirmed to be >90% transduced. Each condition is run in triplicate, and viral replication is monitored using p24 quantitative ELISA (XpressBio, Frederick, MD). Exposure to HIV1 CAR cells is shown to lead to suppression of HIV1 as measured by p24 ELISA.

Effector cells expressing HIV1-CAR are also tested for antiviral activity against infected CD4+ cells. T2-CCRS cells are infected with a panel of HIV-1 strains including primary RS-tropic isolates and cultured in the absence or presence of the HIV1-CAR transduced effector cells. Virus replication is assessed by measurement of p24 antigen between days 7 to 10 of culture. Suppression of replication is calculated as the difference of logio units of p24 between cultures without versus with effector cells, which is then normalized as the ratio to total replication without effector cells.

Chromium Release Killing Assays for CAR-Mediated Killing of HIV-1-Infected Target Cells T2-GLuc cells infected with HIV-1 strain NL4-3 as above are used as target cells for the HIV1-CAR transduced primary CD8+ T lymphocytes in Matador Assay or using standard $^{51}$Cr-release assays as previously described (Bennett, et al. (2007) J Virol 81:4973-4980; Yang, et al. (1996) J Virol 70:5799-5806; and Bennett, et al. (2010) Aids 24:2619-2628). Briefly, infected and control uninfected T2 cells are 51Cr-labeled for 1 hour and incubated with or without effector CD8+ T lymphocytes for 4 hours at varying cell ratios in a 96-well U-bottom plate. Supernatants are then harvested for measurement of extracellular 51Cr by micro204-scintillation counting in 96 well plates. Spontaneous release is measured on target cells without effector cells, and maximal release is measured on target cells lysed with 2.5% Triton X-100. Specific lysis is calculated as: (experimental released chromium−spontaneous release)÷(maximal release−spontaneous release).

Bispecific Antibodies Targeting MPL

Bispecific antibodies such as Bispecific T cell Engagers (BiTE) and Dual affinity retargeting (DART) can be used to retarget T cells to a target cell expressing a particular antigen.

A bispecific T cell engager based targeting MPL based on 161 scFV as the antigen binding domain is constructed. The sequence of this bispecific construct is shown in SEQ ID NO: 3736. The bispecific constructs contain a GGGSG-Streptagx2-Tag linker (SEQ ID NO: 287) but alternate linkers (e.g. SGGGS) can be used.

The bispecific construct was transfected in 293FT cells and supernatant containing the fusion protein collected after 48-96 hours. HEL-GLuc cells cultured with T cells in the presence of the MPL-161 bispecific fusion protein were shown to undergo cell lysis as determined by the GLuc assay as compared to the cells cultured with the bispecific fusion protein alone or T cells alone.

Bispecific antibodies encoding constructs based on 175, 111, hu-161-2, hu-175-2 and hu-111 scFv are next constructed and found to have activity in the HEL-GLuc cytotoxicity assay. Finally, bispecific antibodies targeting a number of other antigens, including PTK7, DLL3, TROP2, CD179a, CD179b, CD23, LAMP1, CDH1, CDH17, CD32, CDH19, HIV1-gp120 envelop glycoprotein etc., are similarly constructed and are found to have activity when co-cultured with the target cell lines expressing their cognate antigen.

Figure 4:
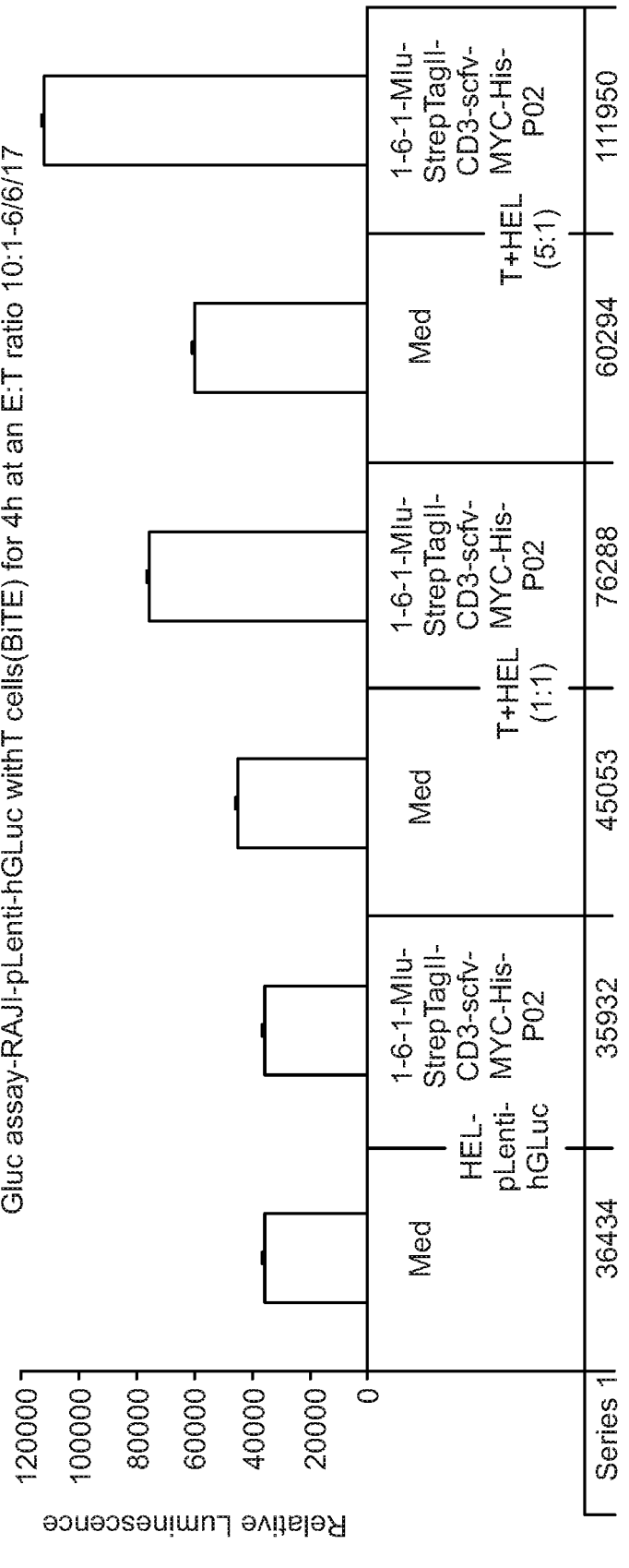
FIG. 4 shows activity of a Bispecific T cell engager targeting MPL and using a 161-scFv targeting domain. HEL-pLenti-hGluc and T cells were pre-incubated separately with the following supernatants at 4° C. for 2 h in Medium alone and pLenti-161-StreptagII-CD3-Myc-His-P02 (042517-P02-SC). Post-incubation, cells were co-cultured in U-bottom 96-well plate at an E:T ratio of 1:1 or 5:1 for 4 h at 37 C. 50 µl of cells+sup/well were transferred to 384 well plate in triplicate. hGLuc assay was performed using 15 ul of CTZ assay buffer (1:100).

FIG. 4. Activity of a Bispecific T cell engager targeting MPL and using a 161-scFv targeting domain. HEL-pLenti-hGluc and T cells were pre-incubated separately with the following supernatants at 4° C. for 2 h Medium alone and pLenti-161-StreptagII-CD3-Myc-His-P02 (042517-P02-SC). Post-incubation, cells were co-cultured in U-bottom 96-well plate at an E:T ratio of 1:1 or 5:1 for 4 h at 37 C. 50 µl of cells+sup/well were transferred to 384 well plate in triplicate. hGLuc assay was performed using 15 ul of CTZ assay buffer (1:100).

Expression and Activity of TFPs in Jurkat Cells Lacking TCRα and TCRβ Expression.

Jurkat-NFAT-GFP (J-N-G) cells (T cell lymphoma) are infected with lentiviral vectors expressing gRNAs targeting TCRα and TCRβ1/β2 constant chains and coexpressing Streptococcus Pyogenes Cas9. The exemplary gRNA target sequences for TCRα chains are given in SEQ ID NO: 7754 and 7755. The exemplary gRNA target sequences for TCRβ1/β2 chains are given in SEQ ID NO: 7756-7758. In an alternative embodiment, the TCRα and TCRβ1/β2 constant chain loci are targeting using gRNA and TALONs as described in Knipping F et al, Molecular Therapy: Methods & Clinical Development, Vol 4, 2017. J-N-G cells lacking the expression of TCRα or TCRβ1/β2 chains are purified by cell sorting using antibodies directed against TCR/CD3 complex. Lentiviral vectors expressing TFPs directed against human MPL (SEQ ID NO: 2184, 2490, 2796) under EF1α promoter are used to infect parental J-N-G cells (control) and those lacking the expression of TCRα or TCRβ1/β2 chains. Expression of TFPs in the cells is determined by immunostaining with Protein L staining and by staining with MPL-ECD-GGSG-NLuc-AcVS fusion protein (SEQ ID NO: 4923). J-N-G parental cells show robust TFP expression on cell surface while J-N-G cells lacking TCRα or TCRβ1/β2 chains show poor to absent TFP expression. The different populations of J-N-G cells are exposed to HEL.92.1.7 target cells for 24 hours and examined for increase in NFAT-promoter driven GFP expression and IL2 production. J-N-G parental cells expressing MPL-specific TFPs show marked increase in GFP fluorescence and IL2 secretion upon co-culture with HEL.92.1.7 cells. In contrast, MPL-specific TFP-expressing J-N-G cells with absent TCRα or TCRβ1/β2 chains show weak to no GFP induction and IL2 secretion. Essentially similar results are obtained when the experiment is repeated with J-N-G parental and TCRα- or TCRβ1/β2-deficient cells upon expression of TFPs targeting CD19 (SEQ ID NO: 1913, 2219, 2525), CD20 (SEQ ID NO: 1945, 2251, 2557) and CD22 (SEQ ID NO: 1950, 2256, 2562) and upon coculture with RAJI and Nalm6 target cells.

Next lentiviral vectors expressing codon optimized TCRα constant chain (IgSP-[hTRAC-opt2]; SEQ ID NO: 1010) or TCRβ constant chain (IgSP-[hTRBC-opt2]; SEQ ID NO: 1011) under EF1α promoter are used to infect the different J-N-G cell populations. Expression of TCRα constant chain in MPL-specific TFP-expressing J-N-G cells in which the TCRα chain has been disrupted by gRNA mediated gene knock out results in increased expression of TFP on the cell surface and induction of GFP expression and IL2 secretion upon co-culture with HEL.92.1.7 target cells. Similarly, expression of TCRβ constant chain in MPL-specific TFP-expressing J-N-G cells in which the TCRβ1/β2 chain has been disrupted by gRNA-mediated gene knock out results in increased expression of TFP on the cell surface and induction of GFP expression and IL2 secretion upon co-culture with HEL.92.1.7 target cells Expression and Activity of Ab-TCR and cTCR/SIRs in Jurkat Cells Lacking TCRα and TCRβ Expression.

The above experiment is repeated with the exception that expression cassettes encoding Ab-TCRs and SIRs targeting human CD19 are used in place of TFPs targeting CD19. The Ab-TCRs targeting CD19 is represented by SEQ ID NO: 3124. The cTCR/SIRs targeting CD19 are represented by SEQ ID NO: 3878-3880. Expression of Ab-TCR, cTCR and SIR in J-N-G cells lacking TCRα or TCRβ1/β2 expression is shown to results in increased expression and activity as compared to their expression in parental J-N-G cells.

Allogeneic and Off-the-Shelf T Cells Expressing CAR, TFP and Ab-TCR of the Disclosure Allogeneic or off-the-shelf CAR-T cells are generated by decreasing or eliminating the expression of endogenous TCRα and/or TCRβ chain using TALON, CRISP/Cas9 or other nucleases.

The MPL-specific TFP cassettes (SEQ ID Nos: 3527, 3529, 3531) are cloned in targeting constructs designed for targeting into the TRAC genomic locus and containing the right and left homology arms derived from TRAC genomic sequences. A polyadenylation sequence is inserted downstream of the stop codon of the TFPs. The schematic of the targeting construct and the targeting strategy is shown in FIG. 5A. The sequences of the targeting constructs are provided in SEQ ID NO: 3858, 7773 and 7776. The targeting constructs are cloned in an integration defective lentiviral vector (IDLV) and an Adeno-Associated Viral (AAV) vector. The constructs are directed to the TRAC locus in purified human T cells using CRISP/Cas9 (FIG. 5A) as described in techniques known in the art and using the TRAC gRNA sequence (SEQ ID NO: 7751): 5'C*A*G*GGUUCUGGAUAUCUGUGUUUUAGAGCUAGAAAUAGCAAGUU AAGGCUAGUCCGUUAUCAAC-UUGAAAAAGUGGCACCGAGUCGGUGCU* U* U* U-3'. Asterisk (*) represents 2'-O-methyl 3' phosphorothio-ate. Exemplary techniques to deliver targeting constructs to the TRAC locus using IDLV and AAV are described in Knipping F et al, Molecular Therapy: Methods & Clinical Development, Vol 4, 2017 and Eyquem J et al Nature, 543(7643):113-117, 2017, respectively. In parallel, purified human T cells are also transduced using the conventional approach with lentiviral vectors encoding the corresponding TFP constructs (SEQ ID NO: 2184, 2490, 2796) under EF1a promoter to generate cells expressing the different TFPs. Expression of TCRαβ and TFPs in the T cells is determined by immunostaining with TCR/CD3 antibodies and Protein L staining, respectively. Expression of TFPs on T cells is also examined by staining with MPL-ECD-GGSG-NLuc-AcV5 fusion protein (SEQ ID NO: 4923). The different populations of T cells are exposed to HEL.92.1.7-GLuc target cells and are compared using in vitro and in vivo assays of cell activation, proliferation, cytokine production (e.g., IL2), target cell lysis, senescence, exhaustion, in vivo expansion, in vivo persistence and in vivo anti-tumor activity. TFPs show impaired expression on T cells surface and reduced or absent activity (e.g., T cell activation, proliferation, cytokine production and cytotoxicity etc.) in T cell when their expression is directed to the TRAC locus as compared to when they are expressed using lentiviral vectors. It is next tested if expression of TCRα constant chain (TRAC chain) can be used to restore TFP expression and signaling and activity in T cells in which the endogenous TRAC genomic locus has been disrupted by the TFP expression cassette. For this purpose, targeting constructs are constructed that coexpress TFPs with an accessory module encoding a TCRα constant chain with an amino terminal signal peptide (IgSP) (FIG. 5B). The accessory module is separated from the TFP encoding sequence by a Furine-SGSG-P2A linker. The nucleotide sequence of exemplary targeting constructs coexpressing a TCRα constant chain with TFP constructs targeting MPL are shown in SEQ ID NOs: 3859, 7774, and 7777). The nucleotide sequence of the TCRα constant chain in these constructs is codon optimized and differs from the endogenous TCRα constant chain in its nucleotide sequence. In an alternate embodiment, the TRAC chain is codon optimized and carries amino acid substitutions that are known to enhance the expression of human TCRα constant chain. The nucleotide sequence of exemplary exogenous TRAC chains that can be used to allow re-expression of TCR/CD3 complex in T cells in which the expression of endogenous TCRα gene has been down-regulated or eliminated by targeting are shown in SEQ ID NO: 3886 to 3894. The exogenous TRAC can be expressed in T cells either by itself (SEQ ID NO: 1010) or it can be co-expressed with the TFP expression cassettes using a single vector.

The MPL-specific TFP constructs (SEQ ID Nos: 3858, 7773 and 7776) and TFP-TRAC constructs (SEQ ID NOs: 3859, 7774, and 7777) are cloned in the IDLV and AAV vector and are directed to the TRAC locus essentially as described previously.

The cells expressing the constructs are exposed to HEL.92.1.7-GLuc target cells and tested in functional assays as described above. T cells in which the TFP-TRAC constructs are directed to the TRAC locus show better expression of TFP on cell surface as compared to T cells in which the TFP constructs alone (i.e. without coexpression of the exogenous TRAC chain) are directed to the TRAC locus. In addition, T cells in which the TFP-TRAC constructs are directed to the TRAC locus show greater proliferation, activation, cytokine (e.g., IL2 and TNFα) production, cytotoxicity, in vivo expansion, in vivo anti-tumor activity against the target cells as compared to T cells in which the TFP constructs alone (i.e. without coexpression of the exogenous TRAC chain) are directed to the TRAC locus.

The expression and activity of TFPs is also restored in T cells in which the endogenous TRAC locus has been disrupted by designing the targeting cassette such that TFP cassette is followed in frame by a 2A cleavable linker, a signal peptide (e.g., a CD8 signal peptide or an IgH signal peptide) and the first exon of the TCRα chain (TRAC) (FIG. 5C). The nucleotide sequence of exemplary targeting constructs is shown in SEQ ID NO: 3860, 7775 and 7778. In this embodiment, the TRAC protein is produced by the endogenous TRAC chain whose cell surface expression is facilitated by the signal peptide provided in the targeting cassette.

The alloreactivity of the TFP-TRAC-expressing T cells which lack the expression of native TCRα chain but in which the TFP cell surface expression and activity is rescued by the expression of TCRα constant chain is tested using mixed lymphocyte culture reaction using irradiated T cells derived from an allogeneic donor. TFP-TRAC-expressing T cells which lack the expression of native TCRα show markedly reduced to absence of alloreactivity as measured by proliferative response as compared to T cells in which TFPs are expressed using lentiviral vectors. The ability of TFP-TRAC-expressing human T cells which lack the expression of native TCRα to induce Graft vs Host Disease (GVHD) is examined by administration of 5 million TFP-TRAC-expressing TCRa-deficient T cells per animal into immunodeficient NSG mice (Jackson Lab). Animals are observed for over 90 days. Human T cells in which the TFP-TRAC-cassettes are directed to the TRAC locus show markedly reduced to absence of Graft vs Host Disease (GVHD) when infused into immunodeficient NSG mice (Jackson Lab) while GVHD is observed in animals given T cells in which TFP are expressed using lentiviral vectors. The ability of TFP-TRAC-expressing TCRa-deficient T human T cells to induce Graft vs Host Disease (GVHD) is also examined by administration of 1 million cells per kilogram into allogeneic human recipients who have received lymphodepleting chemotherapy. Allogeneic T cells in which the TFP-TRAC cassettes are directed to the TRAC locus show markedly reduced incidence and severity of Graft vs Host Disease (GVHD) when given to allogeneic recipients.

Essentially similar results are obtained when the experiment is repeated with T cells in which the TFPs are directed to the TRBC locus. The target sequence of gRNA targeting TRBC are shown in SEQ ID NO: 7756-7758. These gRNAs are used in combination with Streptococcuc Pyogenes Cas9 using methods known in the art. Directing the TFP expression cassettes to the TRBC genomic locus is shown to result in impaired activity of the MPL-specific TFPs. However, the activity of TFPs is restored by coexpression of exogenous TCRβ constant chain (TRBC). The nucleotide sequence of exemplary exogenous TRBC chains that can be used to restore TCR/CD3 complex signaling function are shown in SEQ ID NO: 3899-3910. The exogenous TRBC can be expressed in T cells either by itself (SEQ ID NO: 1011) or it can be co-expressed with the TFP expression cassettes from a single vector. The nucleotide sequence of exemplary constructs coexpressing a TRBC chain with TFP constructs targeting MPL are shown in SEQ ID NO: 3537, 3539 and 3541. These TFP expression constructs can be cloned in suitable TRBC targeting vectors using techniques known in the art. In an alternate embodiment, the expression of TRBC can be restored in T cells in which the endogenous TRBC locus has been disrupted by designing the targeting cassette such that TFP cassette is followed in frame by a 2A cleavable linker, a signal peptide (e.g., a CD8 signal peptide or an IgH signal peptide) and the first exon of the TCRβ chain (TRBC).

Directing the Ab-TCR Constructs to the TRAC Locus

Two Ab-TCR constructs targeting CD19 based on FMC63 scFv are generated in lentiviral vector (SEQ ID NO: 3837) driven by EF1α promoter. The nucleotide sequences of these constructs, CD8SP-FMC63-vL-RgCL-TCRb-IAH-6MD1-F-P2A-SP-FMC63-vH-[IgG1-CH1-TCRa-SDVP-6MD] and CD8SP-FMC63-vL-KgCL-TCRg-6MD1-F-P2A-SP-FMC63-vH4-[IgG1-CH1-TCRd-6MD] are represented by the nucleotide sequences encoding the Ab-TCR component of SEQ ID NO: 3124 and 3324. Primary human T cells are infected with the corresponding lentiviral supernatants and assayed for the cell surface expression of the Ab-TCRs using FLAG-CD19-ECD-GGSG-NLuc-AcV5 supernatant (SEQ ID NO: 1014) and for cytotoxicity against RAJI-GLuc cells. T cells expressing the Ab-TCRs show modest expression and activity. The expression of the Ab-TCRs is directed to the TRAC locus essentially as described by Eyquem J et al (Nature, 543(7643):113-117, 2017) using gene targeting constructs (see, FIG. 6) and represented by SEQ ID NO: 3861-3864. The targeting construct contains a splice acceptor (SA), followed by a F2A coding sequence, the Ab-TCR cassette, flanked by sequences homologous to the TRAC locus (LHA and RHA, left and right homology arm). In cassettes A and B (SEQ ID NO: 3861-3862), the nucleotide sequence coding the Ab-TCR expression cassettes are followed by a stop codon, polyA sequences, Exon 1 of TRAC and the sequence homologous to the TRAC locus (RHA: right homology arm). In cassette C, nucleotide sequence coding the Ab-TCR expression cassette is followed by a stop codon, Exon 1 of TRAC and the sequence homologous to the TRAC locus (RHA: right homology arm) but without a poly A sequence so that the transcript carries at its 3' end the TRAC gene and its polyadenylation sequence. In cassette D, the Ab-TCR cassette lacks its own TCRα module and extends only upto the IgG1-CH1 region, which is fused in frame to 3' half of the first exon of TRAC. Thus, in this construct, the TCRα module is encoded by the genomic TRAC locus containing part of exon 1, and whole of exon 2 and exon 3. Cassette E resembles cassette D except that the RHA in the targeting construct carries mutations (SDVP) that can enhance the expression of TRAC. T cells in which the Ab-TCR cassettes are directed to the TRAC locus uniform and physiological expression and long-term persistence and activity of the transgene as determined using in vivo and in vitro assays as compared to Ab-TCR cassettes expressed using lentiviral vectors. The Ab-TCR expressing T cells are purified by staining with PE-Protein L followed by flow sorting. The alloreactivity of the Ab-TCR-expressing T cells is tested using mixed lymphocyte culture reaction using irradiated T cells derived from an allogeneic donor. T cells in which the Ab-TCRs are directed to the TRAC locus show markedly reduced to absence of alloreactivity as measured by proliferative response as compared to T cells in which Ab-TCRs are expressed using lentiviral vectors. The ability of Ab-TCR expressing human T cells to induce Graft vs Host Disease (GVHD) is examined by administration of 5 million Ab-TCR expressing T cells per animal into immunodeficient NSG mice (Jackson Lab). Animals are observed for over 90 days. Human T cells in which the Ab-TCR cassettes are directed to the TRAC locus show markedly reduced to absence of Graft vs Host Disease (GVHD) when infused into immunodeficient NSG mice (Jackson Lab) while GVHD is observed in animals given T cells in which Ab-TCRs are expressed using lentiviral vectors. The ability of Ab-TCR expressing human T cells to induce Graft vs Host Disease (GVHD) is also examined by administration of Ab-TCR expressing T cells (1 million cells per kilogram) into allogeneic human recipients. Allogeneic T cells in which the Ab-TCR cassettes are directed to the TRAC locus show markedly reduced incidence and severity of Graft vs Host Disease (GVHD) when given to allogeneic recipients. Essentially similar results are obtained using T cells in which Ab-TCR are expressed by directing the expression cassettes to the TRBC locus.

Directing the Chimeric TCR or Synthetic Immune Receptors (SIR) Constructs to the TRAC Locus Three cTCRs (or SIR) constructs targeting CD19 based on FMC63 scFv are generated in lentiviral vector (SEQ ID NO: 3837) driven by EF1α promoter. The nucleotide sequences of these constructs are represented by SEQ ID NO: 3878, 3879 and 3880, respectively. They all have the same vL and vH regions. While the SEQ ID NO: 3880 has the wild-type nucleotide sequence of TCRα and TCRβ constant chains, the SEQ ID NO: 3878 and 3879 have codon optimized sequences. The SEQ ID NO: 3878 further carries several amino acid substitutions to enhance the expression and base-pairing of the TCRα and TCRβ constant chains. Primary human T cells are infected with the corresponding lentiviral supernatants and assayed for the cell surface expression of the SIR using FLAG-CD19-ECD-GGSG-NLuc-AcV5 supernatant (SEQ ID NO: 1014) and for cytotoxicity against RAJI-GLuc cells. The cTCR/SIR construct with SEQ ID NO: 3880 is not found to express well or to induce target cell lysis. The cTCR/SIR are also directed to the TRAC locus essentially as described by Eyquem J et al (Nature, 543(7643):113-117, 2017) using exemplary gene targeting constructs (see, FIG. 7) represented by SEQ ID NO: 3865 to 3868, and 3873. The targeting construct contains a splice acceptor (SA), followed by a F2A coding sequence, the Ab-TCR cassette, flanked by sequences homologous to the TRAC locus (LHA and RHA, left and right homology arm). In cassettes A and B (SEQ ID NO: 3865, 3866 and 3873), the nucleotide sequence coding the SIR expression cassettes are followed by a stop codon, polyA sequences, Exon 1 of TRAC and the sequence homologous to the TRAC locus (RHA: right homology arm). In cassette E, nucleotide sequence coding the SIR expression cassette is followed by a stop codon, Exon 1 of TRAC and the sequence homologous to the TRAC locus (RHA: right homology arm) but without an intervening poly A sequence so that the transcript carries at its 3' end the TRAC gene and its polyadenylation sequence. In cassette D, the SIR cassette lacks its own TCRα module and extends only upto the FMC63-vH region, which is fused in frame to the first exon of TRAC present in the targeting construct. Thus, in this construct, the TCRα module is encoded by the genomic TRAC locus containing part of exon 1, and whole of exons 2 and 3. Cassette F resembles cassette E except that the RHA in the targeting construct carries mutations (CSDVP) in the exons 1 and 2 of TRAC that can enhance the expression of TRAC. T cells in which the cTCR/SIR cassettes are directed to the TRAC locus (SEQ ID NO: 3873) show uniform and physiological expression and long-term persistence and activity of the transgene as determined using in vivo and in vitro assays as compared to cTCR/SIR cassettes expressed using lentiviral vectors. Other cTCRs (SEQ ID NO: 3865-3868) also show uniform expression and activity when directed to the TRAC locus. The cTCR and SIR expressing T cells are purified by staining with FITC conjugated CD3 antibody and PE-Protein L followed by flow sorting. The alloreactivity of the cTCR- and SIR-expressing T cells is tested using mixed lymphocyte culture reaction using irradiated T cells derived from an allogeneic donor. T cells in which the cTCR/SIR are directed to the TRAC locus show markedly reduced to absence of alloreactivity as measured by proliferative response as compared to T cells in which cTCR/SIR are expressed using lentiviral vectors. The ability of cTCR/SIR expressing human T cells to induce Graft vs Host Disease (GVHD) is examined by administration of 5 million cTCR/SIR expressing T cells per animal into immunodeficient NSG mice (Jackson Lab). Animals are observed for over 90 days. Human T cells in which the cTCR/SIR cassettes are directed to the TRAC locus show markedly reduced to absence of Graft vs Host Disease (GVHD) when infused into immunodeficient NSG mice (Jackson Lab) while GVHD is observed in animals given T cells in which cTCR/SIR are expressed using lentiviral vectors. The ability of cTCR and SIR expressing human T cells to induce Graft vs Host Disease (GVHD) is also examined by administration of cTCR/SIR expressing T cells (1 million cells per kilogram) into allogeneic human recipients who have received lymphodepleting chemotherapy. Allogeneic T cells in which the cTCR/SIR cassettes are directed to the TRAC locus show markedly reduced incidence and severity of Graft vs Host Disease (GVHD) when given to allogeneic recipients. Essentially similar results are obtained using T cells in which cTCR and SIR are expressed by directing the expression cassettes to the TRBC locus.

Directing a TCR or a cTCR/SIR Constructs to the TRAC Locus

A TCR construct and a cTCRs (or SIR) construct targeting NY-ESO-1/HLA-A2 complex are generated in lentiviral vector (SEQ ID NO: 3837) and are based on TCR NYESO-1G4 and TCR mimic antibody NYESO-35-15. The nucleotide sequences of these constructs are represented by SEQ ID NO: 3883 and 3882, respectively. The two constructs are also targeted to the TRAC locus using the targeting constructs represented by SEQ ID NO: 3874-3877. The design of the targeting construct is shown in FIG. 8. T cells in which the NY-ESO-1 TCR or cTCR is directed to the TRAC locus show uniform expression of the transgene, good recognition of target cells expressing NY-ESO-1/HLA-A2 complex and perform equally well or better than T cells in which the above constructs are expressed using lentiviral mediated gene transfer using in vivo assays. Human T cells in which the NY-ESO-1 TCR or cTCR is directed to the TRAC locus also show reduced alloreactivity in mixed lymphocyte reaction and reduced GVHD in NSG mice xenograft model as compared to the T cells in which the NY-ESO-1 or cTCR are expressed using lentiviral mediated gene transfer.

Directing a Single Chain cTCR/SIR Construct to the TRAC Locus

Single chain cTCR/SIRs in which FMC63-scFv is attached to codon optimized TCRα constant chain or codon optimized plus murinized TCRα constant chain (SEQ ID NO: 3881) are expressed in T cells using lentiviral vector and show poor expression and activity. The same constructs are directed to the TRAC locus using the targeting constructs shown in FIG. 9 and represented by SEQ ID NO: 3869-3872. T cells in which the single chain cTCRs/SIRs are directed to the the TRAC locus show uniform expression and activity of the cTCR when assayed using the assays described previously. In addition, T cells in which the single chain cTCR/SIR are directed to the TRAC locus show reduced incidence of alloreactivity using MLR and reduced incidence of GVHD using NSG mice xenograft model as compared to the T cells in which the the NY-ESO-1 or cTCR are expressed using lentiviral mediated gene transfer.

In the above examples, the CAR/TFP/Ab-TCR/TCR/cTCRs are directed to the TRAC locus. Essentially a similar procedure can be used to direct the CAR/TFP/Ab-TCR/TCR/cTCR or an accessory module to the TCBC, CD3ε, CD3δ, CD3γ, and CD3ζ loci using techniques known in the art.

a Shorter EF1α Promoter Retains Strong Promoter Activity in T Cells and is Suitable for Adoptive Cellular Therapy Use of strong viral promoters in adoptive cellular therapy applications carries the risk of activation of downstream oncogenes and development of cancer. As such, human Elongation Factor 1α (EF1α) promoter is frequently used in adoptive cellular therapy applications as it provides strong expression and is human in origin. A limitation of EF1α promoter, however, is its relatively large size. Although a mini-EF1α promoter has been described, it is much weaker as compared to the EF1α promoter. To determine whether an internal deletion in the EF1α promoter would allow shortening of its length while preserving its promoter strength, a SacII fragment was deleted from the EF1α promoter. The nucleotide sequence of the resulting EF1α-D-SacII promoter is presented in SEQ ID NO: 3842. Lentiviral vectors encoding a CD19-directed FMC63-BBz CAR were constructed in the vectors with the wild-type EF1α promoter (SEQ ID NO: 3840) or EF1α-D-SacII promoter (SEQ ID NO: 3839). The vectors also co-expressed EGFP and blasticidin resistance gene via 2A linkers. Lentiviruses were generated in 293FT cells and used to infect J-N-G cells. Infected cells were selected with blasticidin and then tested for their ability to induce EGFP expression upon co-culture with CD19+ve RAJI cells. Near equivalent inducton of EGFP expression was observed in J-N-G cells transduced with either lentiviral construct. In addition, near equivalent expression of the FMC63-BBz CAR was observed on the surface of J-N-G cells transduced with either construct as determined by binding with CD19-ECD-GGS-NLuc fusion protein. These results demonstrate that the EF1α-D-SacII promoter can be used for adoptive cellular therapy applications. The results further demonstrate that the EF1α-D-SacII promoter is not more prone to silencing than the the wild-type EF1α promoter and can be used for long-term transgene expression.

Use of Water Soluble Dasatinib Salt for Control of Cytokine Release Syndrome and Neurological Complications Observed During Adoptive Cellular Therapy Dasatinib is a poorly water soluble drug and commercial Dasatinib is a monohydrate and reported to have solubility of 8 μg/mL at 24° C. As patients with CRS and neurological complications have difficulty taking the oral form of Dasatinib, water soluble form of Dasatinib is desirable. Water soluble salts of Dasatinib have been described in WO2015107545 A1. Injectable compositions comprising soluble salts of Dasatinib methane sulphonate monohydrate can be prepared according to the method of WO2015107545 A1 and used to treat patients with CRS and neurological complications associated with administration of CAR-T cells and Blinatumomab. The dose of Dasatinib methane sulphonate monohydrate can be titrated up to achieve an effective plasma concentration. In an exemplary embodiment, the plasma concentration of Dasatinib is kept higher than 10 nM, 20 nM, 50 nM, 100 nM, 200 nM or 300 nM. In another exemplary embodiment, the plasma concentration of Dasatinib is kept higher than 5 ng/ml, 15 ng/ml, 25 ng/ml, 50 ng/ml or 75 ng/ml. Finally, Dasatinib methane sulphonate monohydrate dissolved in normal saline can be also used for intra-thecal administration in patients with neurological complications from CAR-T cells and Blinatumomab. In an exemplary embodiment, the intra-thecal dose of Dasatinib methane sulphonate is adjusted to achieve CSF concentration higher than 10 nM, 20 nM, 50 nM, 100 nM, 200 nM or 300 nM. In an exemplary embodiment, the intra-thecal dose of Dasatinib methane sulphonate is adjusted to achieve CSF concentration higher than higher than 5 ng/ml, 15 ng/ml, 25 ng/ml, 50 ng/ml or 75 ng/ml.

Use of Autologous T Cells Expressing Conventional CARs and Backbones 1-72 Targeting Multiple Antigens for Adoptive Cell Therapy Patients with many different diseases, including infectious diseases (e.g., HIV1, EBB, CMV, HTLV1, etc), degenerative diseases (e.g., Alzheimer's disease), allergic diseases (e.g., chronic idiopathic urticarial) and multiple cancers will be enrolled in an IRB approved phase I clinical trial of immunotherapy with adoptively transferred autologous CAR-T cells coexpressing NEMO-K277A (backbone 2) targeting different disease-causing or disease-associated antigens. The CAR for different diseases will be selected based on the known expression of their target antigen in the disease-causing or disease-associated cells. Where possible, the expression of the CAR target on the disease causing or disease associated cells will be confirmed by binding with Antigen binding domain-GGS-NLuc fusion protein in which the antigen binding domain of the CAR is fused to non-secretory form of NLuc protein via a flexible linker. Alternatively, immunohistochemistry or flow cytometry using commercially available antibodies will be used to confirm the expression of the target antigen of the CAR on disease-causing or disease-associated cells. T cells will be collected from the subjects using leukopheresis, transduced with the appropriate lentivirus vectors and expanded ex vivo using CD3/CD28 beads in a closed system. After the resulting cell products have undergone quality control testing (including sterility and tumor specific cytotoxicity tests), they will be cryopreserved. CAR-T cell products will be administered to the subjects as described in the preceding example. Clinical and laboratory correlative follow-up studies can then be performed at the physician's discretion. Essentially a similar approach is used to test CARs in other backbones described in this disclosure.

Use of Allogeneic T Cells Expressing Conventional CARs and Backbones 1-72 Targeting Multiple Antigens for Adoptive Cell Therapy Patients with many different diseases, including infectious diseases (e.g., HIV1, EBB, CMV, HTLV1, etc), degenerative diseases (e.g., Alzheimer's disease), allergic diseases (e.g., chronic idiopathic urticarial) and multiple cancers will be enrolled in an IRB approved phase I clinical trial of immunotherapy with adoptively transferred allogenic CAR-T cells targeting different disease-causing or disease-associated antigens. The CAR for different diseases will be selected based on the known expression of their target antigen in the disease-causing or disease-associated cells. Where possible, the expression of the CAR target on the disease causing or disease associated cells will be confirmed by binding with Antigen binding domain-GGS-NLuc fusion protein in which the antigen binding domain of the CAR is fused to non-secretory form of NLuc protein via a flexible linker. Alternatively, immunohistochemistry or flow cytometry using commercially available antibodies will be used to confirm the expression of the target antigen of the CAR on disease-causing or disease-associated cells. T cells will be collected from a healthy donor using leukopheresis. The CAR expression cassette (SEQ ID NO: 1900 to SEQ ID NO: 2205) are cloned in the targeting vector and the CAR module is directed to the TRAC locus in the T cells essentially as described by (Eyquem J et al, Nature, 543(7643):113-117). T cells lacking CD3 expression on the surface are selected by immunomagnetic purification and then expanded ex vivo using CD3/CD28 beads in a closed system. After the resulting cell products have undergone quality control testing (including sterility and tumor specific cytotoxicity tests), they will be cryopreserved. CAR-T cell products will be administered to the subjects as described in the preceding example. Clinical and laboratory correlative follow-up studies can then be performed at the physician's discretion. Essentially a similar approach is used to test CARs in other backbones, including CARs that co-express TCRα constant chain (TRAC) lacking the Va domain, described in this disclosure.

CAR-T Cell Hepatic Arterial Infusion

In addition to intravenous infusion, T cells expressing the conventional CARs and backbones 1-72 described in this invention can be infused intra-arterially to provide high concentration of CAR-T cells in a local area or organ involved with a disease. In the following example, this approach is used in case of a patient with hepatic metastases from a gastrointestinal cancer which expresses Folate Receptor alpha (FR1). Essentially a similar approach can be used for intra-arterial infusion of T cells expressing conventional CARs and backbones 1-72 targeting other tumor antigens.

A mapping angiogram will be performed via a right common femoral artery approach at baseline. The gastroduodenal and right gastric arteries, in addition to other potential sources of extrahepatic perfusion, will be embolized with microcoils. The same arterial access procedure will be carried out for administration of T cells expressing the construct CD8SP-FR1-huMov19-(vL-vH)-Myc-z-P2A-hNEMO-K277A-T2A-PAC (SEQ ID NO: 1727). The T cells will be collected from the patient on day 0 and will be infected with lentivirus encoding the construct CD8SP-FR1-huMov19-(vL-vH)-Myc-z-P2A-hNEMO-K277A-T2A-PAC and expanded as described in the previous examples. The CAR-T cells will be given in a dose escalating fashion on day 14 ($10^7$ CAR-T cells), day 28 ($10^8$ CAR-T cells) and day 44 ($10^9$ CAR-T cells). The CAR-T cells will be injected manually via a 60 cc syringe at a rate of <2 cc/second. The total volume of infusion will be approximately 100 cc. Angiography with calibrated contrast rate will be performed after the first infusion of 50 cc and at completion of the CAR-T infusion to confirm preserved arterial flow. Infusions will be delivered into the proper hepatic artery when possible. Certain patients may have aberrant hepatic arterial anatomy, where either the right or left hepatic artery does not arise from the proper hepatic artery. In such cases the dose of CAR-T cells will be split based upon lobar volume calculations. In such cases, split doses will be delivered separately into the right and left hepatic arteries to ensure proportionate CAR-T delivery to both hepatic lobes.

Intraperitoneal Administration of CAR-T Cells

CAR-T cells can also be administered intraperitoneally, essentially as described in Koneru M et al (Journal of Translational Medicine; 2015; 13:102). In the following example, this approach is used in patients with peritoneal involvement with ovarian cancer which expresses Folate Receptor alpha (FR1). Essentially a similar approach can be used for intra-peritoneal infusion of CAR-T cells targeting other tumor antigens described in this disclosure.

A screening informed consent will be offered to patients with recurrent high-grade serous ovarian cancer to test their cancer for the expression of FR1. After expression of FR1 is confirmed by immunohistochemistry, then patients will have a leukapheresis product obtained from peripheral blood. Excess platelet and red blood cell contamination will be removed from the leukapheresis product and the product will be frozen. In the treatment phase of the study, the leukapheresis product will be thawed and washed. Subsequently, CD3+ T cells will be isolated from the thawed leukapheresis product by magnetic separation using CD3/CD28 beads. Activated T cells will be lentivirally transduced with the CD8SP-FR1-huMov19-(vL-vH)-Myc-z-P2A-hNEMO-K277A-T2A-PAC construct and further expanded using CD3/CD28 bead expansion protocol.

Patients with recurrent high-grade serous ovarian, primary peritoneal or fallopian tube carcinoma shown to express FR1 antigen confirmed by immunohistochemistry (IHC) analysis of banked (paraffin embedded) or freshly biopsied tumor will potentially be eligible for the study.

The phase I dose-escalation dosing will be used in the trial. Cohorts of 3-6 patients will be infused with escalating doses of modified T cells to establish the maximum tolerated dose (MTD). There will be four planned dose levels: $3×10^5$, $1×10^6$, $3×10^6$, and $1×10^7$ CAR-T cells/kg. Cohorts I and II will be treated with $3×10^5$ CAR-T cells/kg but patients in cohort II will also receive lymphodepleting cyclophosphamide. Cohorts II-V will receive escalating doses of the modified T cells following pretreatment with cyclophosphamide. Lymphodepleting cyclophosphamide dosed at 750 mg/m² will be administered 2-4 days prior to the initial T cell infusion. A standard 3+3 dose escalation schema will be followed.

An IP catheter will be placed prior to T cell infusion. Patients will be admitted to the inpatient unit of the hospital prior to their first infusion of CAR T cells and will remain hospitalized until at least 3 days after the second infusion of CAR T cells. The first cohort of patients to be treated, and the first patient treated in each subsequent cohort, will be admitted to the intensive care unit (ICU); subsequent patients may be admitted to the medical oncology inpatient service (subject to the clinical judgment of the treating physician).

Patients will receive a single dose of lymphodepleting cyclophosphamide (750 mg/m² IV) chemotherapy 2 to 4 days prior to initiating treatment with CAR-modified T cells. The transduced T cells will be quality tested for number, purity, viability, and sterility prior to infusion. All patients will receive 50% of the genetically modified T cell dose intravenously. Patients will be closely monitored for toxicities. One to 3 days later, the remaining dose of T cells will be administered as an IP infusion. At least 3 patients will be treated at dose level 1, with an accrual of no more than 2 patients per month within each dose level. All patients treated in the preceding cohort will be observed for a minimum of 4 weeks from the day of the initial T cell infusion before escalation to the next cohort occurs. Blood samples will be obtained from all patients prior to and following treatment to assess toxicity, therapeutic effects, and survival of the genetically modified T cells.

Use of CAR-T Cells for Intratumoral Injection

CAR-T cells can also be administered intra-tumorally, essentially as described in Brown C E, et al, Clin Cancer Res. 2015 Sep. 15; 21(18): 4062-4072. In the following example, this approach will be used in case of patients with recurrent glioblastoma (GBM) which expresses IL13Ra2. Essentially a similar approach can be used for intra-tumoral injection of T cells expressing conventional CARs or conventional CARs expressing accessory modules (backbones 1-72) targeting other tumor antigens.

A pilot safety and feasibility study will be conducted to test CD8SP-IL13Ra2-Hu108-(vL-vH)-Myc-z-P2A-hNEMO-K277A-T2A-PAC (SEQ ID NO: 1769) expressing T cells in recurrent GBM. All participating patients will be required to give written informed consent. The clinical protocol will be approved by the University of Southern California Institutional Review Board and conducted under an Investigational New Drug Application, and registered at ClinicalTrials.gov. Eligible patients will include adults (18-70 yrs) with recurrent or refractory unifocal supratentorial grade III or IV glioma whose tumors do not show communication with ventricles/CSF pathways and are amenable to resection. Participation in this trial will be independent of IL13Ra2 (or IL13Ra2) tumor antigen status. Patients will be enrolled following initial diagnosis of high-grade glioma (WHO grade III or IV), at which time they will undergo leukapheresis for collection of peripheral blood mononuclear cells (PBMC). These cells will be used to engineer T cells to express the construct CD8SP-IL13Ra2-Hu108-(vL-vH)-Myc-z-P2A-hNEMO-K277A-T2A-PAC containing the puromycin resistance gene (PAC) following infection with the corresponding lentiviral vector as described in the previous examples. Alternatively, the CAR-T cells could be generated following infection with a retroviral vector or using sleeping beauty transposon or by transfection of IVT mRNA. Subsequently, the release tested therapeutic CAR-T cells will be cryopreserved and stored for later use. At the time of first recurrence of the tumor, the research participant will undergo resection of tumor along with placement of a Rickham reservoir/catheter. Concurrently, the therapeutic CAR-T cells will be thawed, re-expanded in vitro using CD3/CD28 beads based rapid expansion protocol. Following recovery from surgery and post baseline MR imaging, the CAR-T cells will be administered directly into the resection cavity via the indwelling catheter, essentially as described (Brown C E, et al, Clin Cancer Res. 2015 21(18): 4062-4072). Cells will be manually injected into the Rickham reservoir using a 21 gauge butterfly needle to deliver a 2 mL volume over 5-10 minutes, followed by 2 mL flush with preservative free normal saline over 5 minutes. The protocol treatment plan will specify an intra-patient dose escalation schedule with a target of 12 CAR T cell doses administered intracranially over a 5 week period comprised of weekly treatment cycles. During cycles 1, 2, 4 and 5, T cell infusions will be performed on days 1, 3 and 5 of the cycle week, and week 3 will be a rest cycle. For safety, in cycle 1 an intrapatient dose escalation strategy, with CART cell doses of $10^7$, $5 \times 10^7$ and $10^8$ cells per infusion administered on days 1, 3 and 5 respectively, will be used and this will be followed by 9 additional CART cell infusions of $10^8$ cells over 4 weeks. Imaging to assess response will be performed during the week 3 rest cycle and after week 5. The guidelines provided in the NCI Common Toxicity Criteria version 2.0 will be followed for the monitoring of toxicity and adverse event reporting.

Use of CAR-T Cells for Ex-Vivo Purging of Bone Marrow or Peripheral Blood Stem Cell Preparation Prior to Transplant CART cells can be used to purge the bone marrow or peripheral blood stem cell preparation of cancer cells prior to stem cell transplant. In the following example, CD8SP-CS1-HuLuc64-(vL-vH)-Myc-z-P2A-hNEMO-K277A-T2A-PAC (SEQ ID NO: 1699) expressing T cells will be used to purge bone marrow or peripheral blood stem cells obtained from a patient with multiple myeloma prior to autologous stem cell (or bone marrow) transplant.

Patient will undergo leukopheresis to collect peripheral blood mononuclear cells (PBMC). T cells will be purified using CD3 beads. These cells will be used to engineer T cells to express the CD8SP-CS1-HuLuc64-(vL-vH)-Myc-z-P2A-hNEMO-K277A-T2A-PAC CAR following infection with the corresponding lentiviral vector as described in the previous examples. Subsequently, the release-tested therapeutic CAR-T cells will be cryopreserved and stored for later use or used fresh. Bone marrow cells and peripheral blood progenitor cell products will be collected from a patient with multiple myeloma following standard procedures. For mobilization of peripheral blood stem cells, patients will receive cyclophosphamide, 3 gm/m² followed by G-CSF, 10 µg/kg subcutaneously each day beginning 24 h after cyclophosphamide until pheresis is complete. Peripheral blood stem cells will be collected once the peripheral blood CD34+-cell count is 15 cells/µl. The collection goal will be to process three blood volumes per day until a minimum of 2.0 times $10^6$ CD34+ cells/kg are reached after processing. The bone marrow and peripheral blood stem cell products will be optionally depleted of Red Blood Cells and/or enriched for CD34 expressing cells using CliniMACS Prodigy® System from Miltenyi Biotec and following the manufacturer's recommendations. The products will be used for ex-vivo purging fresh or cryopreserved. For purging, the bone marrow or peripheral blood stem cell products will be cocultured with thawed CAR-T cells at an effector to target ratio ranging from 5:1 to 30:1 for 4 to 24 hours in XVIVO medium (Lonza) supplanted with 100 IU recombinant human-IL2. Cells will be cultured at 37° C., in a 5% CO2 humidified incubator. At the end of the coculture period, an aliquot of the cells will be taken for sterility and quality testing (including measurement of CFU-GM and flow cytometry for CD34 and CD138 positive cells). The remaining sample will be administered intravenously to the patient who has previously received myeloablative chemotherapy (e.g., high dose Melphalan in two divided doses of 70 mg/m² for a total dose of 140 mg/m²).

Use of Bispecific T Cell Engagers

Proteins encoded by the Bispecific T cell engagers are expressed in Hela cells using the constructs having the SEQ ID Nos listed in Table 13. The proteins are purified using Metal affinity tag or StrepTag II columns using standard protein purification techniques. The purified proteins are tested in phase I clinical trials. Patients are selected based on the expression of the target antigens of the bispecific antibodies using different assays known in the art. The bispecific antibodies are administered by 24 hour infusion. The bispecific antibodies are administered by 24 hour infusion. The guidelines provided in the NCI Common Toxicity Criteria version 2.0 are followed for the monitoring of toxicity and adverse event reporting.

Use of CAR Combinations

Patients with mesothelioma and glioblastomas are administered T cells infected with lentiviruses encoding the following combination of CARs targeting Mesothelin (expressed on mesotheloma), IL13Ra2 (expressed on Glioblastomas) and hematopoietic markers (CD19, CD20, CD22, BCMA). The T cells are either of the wild-type TCR chains or have the TCRα chain knocked out by CRISP/Cas9 approach. It is observed that coexpression in the same T cells with the wild-type TCR chains of a CAR targeting mesothelin with a CAR targeting CD19, CD20, CD22 or BCMA results in increased T cell expansion in vivo as compared to expression of Mesothelin alone. Essentially similar results are obtained with CAR targeting glioblastoma. However, in T cells that are defective in TCR chains, coexpression of TFP based CARs targeting CD20 (SEQ ID NO: 9660) fail to induce in vivo expansion while co-expression of SIR (SEQ ID NO: 9668) or Ab-TCR (SEQ ID NO: 9676) based CARs successfully induces T cells expansion.

Similarly, the various elements, features and steps discussed above, as well as other known equivalents for each such element, feature or step, can be employed in various combinations by one of ordinary skill in this art to perform methods in accordance with the principles described herein. Among the various elements, features, and steps some will be specifically included and others specifically excluded in diverse embodiments.

A number of embodiments have been set forth above to illustrate the disclosure. The following claims further set forth what the Applicants regard as their invention.

TABLE 15

| | | | | | | |
|---|---|---|---|---|---|---|
| Disease | T cells TCR status | Target antigen of 1st CAR | SEQ ID of 1st CAR | Target antigen of 2nd CAR | SEQ ID of 2nd CAR | Tcell Expansion |
| Mesothelioma | Wild Type | Mesothelin | 1505 | None | | Poor |
| Mesothelioma | Wild Type | Mesothelin | 1505 | CD19 | 1016 | Good |
| Mesothelioma | Wild Type | Mesothelin | 1505 | CD19 | 1607 | Good |
| Mesothelioma | Wild Type | Mesothelin | 1505 | CD20 | 1631 | Good |
| Mesothelioma | Wild Type | Mesothelin | 1505 | CD22 | 1644 | Good |
| Mesothelima | Wild Type | Mesothelin | 1505 | BCMA | 1624 | Good |
| Glioblastoma | Wild Type | IL13Ra2 | 1493 | None | | Poor |
| Glioblastoma | Wild Type | IL13Ra2 | 1493 | CD19 | 1016 | Good |
| Glioblastoma | Wild Type | IL13Ra2 | 2075 | CD19 | 1607 | Good |
| Glioblastoma | Wild Type | IL13Ra2 | 2381 | CD20 | 1631 | Good |
| Glioblastoma | Wild Type | IL13Ra2 | 2687 | CD22 | 1644 | Good |
| Glioblastoma | Wild Type | IL13Ra2 | 2687 | BCMA | 1624 | Good |
| Glioblastoma | TCR-alpha-ve | IL13Ra2 | 2075 | CD20 | 9660 | Poor |
| Glioblastoma | TCR-alpha-ve | IL13Ra2 | 2381 | CD20 | 9660 | Poor |
| Glioblastoma | TCR-alpha-ve | IL13Ra2 | 2687 | CD20 | 9660 | Poor |
| Glioblastoma | TCR-alpha-ve | IL13Ra2 | 1493 | NOne | | Poor |
| Glioblastoma | TCR-alpha-ve | IL13Ra2 | 1493 | CD20 | 9668 | Good |
| Glioblastoma | TCR-alpha-ve | IL13Ra2 | 2075 | CD20 | 9676 | Good |
| Glioblastoma | TCR-alpha-ve | IL13Ra2 | 2381 | CD20 | 9668 | Good |
| Glioblastoma | TCR-alpha-ve | IL13Ra2 | 2687 | BCMA | 9362 | Good |
| Glioblastoma | TCR-alpha-ve | IL13Ra2 | 2687 | BCMA | 9362 | Good |

The various methods and techniques described above provide a number of ways to carry out the application. Of course, it is to be understood that not necessarily all objectives or advantages described can be achieved in accordance with any particular embodiment described herein. Thus, for example, those skilled in the art will recognize that the methods can be performed in a manner that achieves or optimizes one advantage or group of advantages as taught herein without necessarily achieving other objectives or advantages as taught or suggested herein. A variety of alternatives are mentioned herein. It is to be understood that some preferred embodiments specifically include one, another, or several features, while others specifically exclude one, another, or several features, while still others mitigate a particular feature by inclusion of one, another, or several advantageous features.

Furthermore, the skilled artisan will recognize the applicability of various features from different embodiments.

SEQUENCE LISTING (15160 sequences)

SEQ ID NO: 1 - DNA, 63 bp, Artificial Sequence
  Synthetic Polynucleotide
atggccttaccagtgaccgccttgctcctgccgctggccttgctgctccacgccgccaggccg

SEQ ID NO: 2 - DNA, 63 bp, Artificial Sequence
  Synthetic Polynucleotide
atggccctgcccgtgacagccctgctgctgcctctggctctgctgctgcacgccgccagaccc

SEQ ID NO: 3 - DNA, 63 bp, Artificial Sequence
  Synthetic Polynucleotide
atggcccttccagtcactgccttgctgttgcctctggcgctcctgctccacgccgctagaccg

SEQ ID NO: 4 - DNA, 63 bp, Artificial Sequence
  Synthetic Polynucleotide
atggccctgcctgtgacagctctgctgctgcctctggcactgctgctgcacgccgccagacct

SEQ ID NO: 5 - DNA, 57 bp, Artificial Sequence
  Synthetic Polynucleotide
atggattggatatggaggatactttttctcgtgggggcagcaaccggggctcattcc

SEQ ID NO: 6 - DNA, 57 bp, Artificial Sequence
  Synthetic Polynucleotide
atggactggatttggcgcatccttttccttgtcggcgctgctaccggcgcgcattcc

SEQ ID NO: 7 - DNA, 57 bp, Artificial Sequence
  Synthetic Polynucleotide
atggactggatttggcgcatccttttccttgtcggcgctgctaccggcgcgcattct

SEQ ID NO: 8 - DNA, 57 bp, Artificial Sequence
  Synthetic Polynucleotide
atggactggatttggcgcatccttttccttgtcggcgctgctaccggcgcccattcc

SEQ ID NO: 9 - DNA, 60 bp, Artificial Sequence
  Synthetic Polynucleotide
atgaggctccctgctcagctcctggggctgctaatgctctgggtctctggaagcagtggg

SEQ ID NO: 10 - DNA, 60 bp, Artificial Sequence
  Synthetic Polynucleotide
atgccacctcctcgcctcctcttcttcctcctcttcctcacccccatggaagtcaggccc

SEQ ID NO: 11 - DNA, 333 bp, Artificial Sequence
  Synthetic Polynucleotide
cagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttgga

SEQ ID NO: 12 - DNA, 330 bp, Artificial Sequence
  Synthetic Polynucleotide
cagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgctt

SEQ ID NO: 13 - DNA, 339 bp, Artificial Sequence
  Synthetic Polynucleotide
cagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggc

SEQ ID NO: 14 - DNA, 333 bp, Artificial Sequence
  Synthetic Polynucleotide
gacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaag

SEQ ID NO: 15 - DNA, 321 bp, Artificial Sequence
  Synthetic Polynucleotide
gacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaac

SEQ ID NO: 16 - DNA, 336 bp, Artificial Sequence
  Synthetic Polynucleotide
gatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaa

SEQ ID NO: 17 - DNA, 336 bp, Artificial Sequence
  Synthetic Polynucleotide
cagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggt

SEQ ID NO: 18 - DNA, 333 bp, Artificial Sequence
  Synthetic Polynucleotide
caggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggt

SEQ ID NO: 19 - DNA, 336 bp, Artificial Sequence
  Synthetic Polynucleotide
gacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagaga

SEQ ID NO: 20 - DNA, 324 bp, Artificial Sequence
  Synthetic Polynucleotide
gacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgt

SEQ ID NO: 21 - DNA, 342 bp, Artificial Sequence
  Synthetic Polynucleotide
ctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtaga

SEQ ID NO: 22 - DNA, 333 bp, Artificial Sequence
  Synthetic Polynucleotide
gacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaa

SEQ ID NO: 23 - DNA, 336 bp, Artificial Sequence
  Synthetic Polynucleotide
gacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagaga

SEQ ID NO: 24 - DNA, 336 bp, Artificial Sequence
  Synthetic Polynucleotide
gacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaag

SEQ ID NO: 25 - DNA, 342 bp, Artificial Sequence
  Synthetic Polynucleotide
gacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagaga

SEQ ID NO: 26 - DNA, 333 bp, Artificial Sequence
  Synthetic Polynucleotide
gacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaa

SEQ ID NO: 27 - DNA, 339 bp, Artificial Sequence
  Synthetic Polynucleotide
gacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaa

SEQ ID NO: 28 - DNA, 339 bp, Artificial Sequence; identical to SEQ ID NO: 27
  Synthetic Polynucleotide

SEQ ID NO: 29 - DNA, 327 bp, Artificial Sequence
  Synthetic Polynucleotide
gagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagaga

SEQ ID NO: 30 - DNA, 333 bp, Artificial Sequence
  Synthetic Polynucleotide
cagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttctt

SEQ ID NO: 31 - DNA, 321 bp, Artificial Sequence
  Synthetic Polynucleotide
gacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaa

SEQ ID NO: 32 - DNA, 324 bp, Artificial Sequence
  Synthetic Polynucleotide
gagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagaga

SEQ ID NO: 33 - DNA, 324 bp, Artificial Sequence
  Synthetic Polynucleotide
gacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagaga

SEQ ID NO: 34 - DNA, 321 bp, Artificial Sequence
  Synthetic Polynucleotide
gacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaa

SEQ ID NO: 35 - DNA, 318 bp, Artificial Sequence
  Synthetic Polynucleotide
gagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaa

SEQ ID NO: 36 - DNA, 339 bp, Artificial Sequence
  Synthetic Polynucleotide
gacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaa

SEQ ID NO: 37 - DNA, 339 bp, Artificial Sequence
  Synthetic Polynucleotide
gacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaa

SEQ ID NO: 38 - DNA, 321 bp, Artificial Sequence
  Synthetic Polynucleotide
gacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaa

SEQ ID NO: 39 - DNA, 318 bp, Artificial Sequence
  Synthetic Polynucleotide
gacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaag

SEQ ID NO: 40 - DNA, 339 bp, Artificial Sequence
  Synthetic Polynucleotide
gacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagaga

SEQ ID NO: 41 - DNA, 321 bp, Artificial Sequence
  Synthetic Polynucleotide
gagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagaga

SEQ ID NO: 42 - DNA, 333 bp, Artificial Sequence
  Synthetic Polynucleotide
gacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaag

SEQ ID NO: 43 - DNA, 321 bp, Artificial Sequence
  Synthetic Polynucleotide
gacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcaca

SEQ ID NO: 44 - DNA, 321 bp, Artificial Sequence
  Synthetic Polynucleotide
gacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcaca

SEQ ID NO: 45 - DNA, 321 bp, Artificial Sequence
  Synthetic Polynucleotide
gacatccagatgacacagactacatcctcactgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcaca

SEQ ID NO: 46 - DNA, 321 bp, Artificial Sequence
  Synthetic Polynucleotide
gagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaag

SEQ ID NO: 47 - DNA, 333 bp, Artificial Sequence
  Synthetic Polynucleotide
gagatcgtgctgacacagagccccgatttccagagcgtgacccctaaagaaaaagtgaccatcacctgtcgggccagcgagagcgtggacacattcggcatcagcttcatgaactggttccagcagaagcccgatcagagccccaagctgctgattcacgccgccagcaatcaaggcagcggagtgcctagcagattttccggctctggcagcggcaccgatttcaccctgaccatcaatagcctggaagccgaggatgccgccacctactactgccagcagagcaaagaggtgcccttcacctttggcggaggcaccaaggtggaaatcaaa

SEQ ID NO: 48 - DNA, 321 bp, Artificial Sequence
  Synthetic Polynucleotide
gccattcagctcacacagagcccttctagcctgagcgcctctgtgggcgacagagtgaccatcacatgtagagccagccagggcatcagcagcgcccagcagaaacctggaaaggcccctaagctgctgatcctggcctggtacagcagcctggaaagcggagtgcctagcagattcagcggctacgatgcctctggcagcggcaccgatttcaccctgacaatatccagcctccagcctgaggacttcgccacctactactgccagcagttcaacagctacccctacaccttcggccagggcaccaagctggaaatcaaa

SEQ ID NO: 49 - DNA, 336 bp, Artificial Sequence
  Synthetic Polynucleotide
gacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaa

SEQ ID NO: 50 - DNA, 333 bp, Artificial Sequence
  Synthetic Polynucleotide
gacatcctgctgacacagtctcccgccacactgtcactgtctccaggcgaaagagccacactgagctgtagagccagccagagcgtggactacgacggcgacagctacctgaactggtatcagcagaagcccggccagcctcctaagctgctgatctacgatgccagcaacctggtgtctggcatccctcctagattttccggcagcggctctggcaccgatttcaccctgaccatcagcagactggaacccgaggacttcgccgtgtaccactgtcagcagagcacagaggacccctggacatttggcggaggcaccaagctggaaatcaaa

SEQ ID NO: 51 - DNA, 333 bp, Artificial Sequence
  Synthetic Polynucleotide
gacatcctgctgacacagtctcccgccacactgtcactgtctccaggcgaaagagccacactgagctgtagagccagccagagcgtggacaactacggcatcagcttcatgaactggtatcagcagaagcccggccagcctcctaagctgctgatctacgccgccagcaatcaaggctctggcatccccagcagattttccggctctggaagcggcaccgacttcaccctgaccataagcagcctggaacctgaggacttcgccatgtacttttgccagcagagcaacgaggtgcccagaacctttggcggaggcaccaagctggaaatcaaa

SEQ ID NO: 52 - DNA, 327 bp, Artificial Sequence
  Synthetic Polynucleotide
gacatcctgctgacacagtctcccgccacactgtcactgtctccaggcgaaagagccacactgagctgcaaggccagtcagaacgtgggcacaaacgtggcctggtatcagcagaagcctggacagcctcctaagctgctgatctacagcgccacctaccggaactctggcatccctgccagattttctggcagcggctctggcaccgagttcaccctgaccatcaccaacgtgcagagcaaggacctggccgactacttctacttctgccagtacaacagatacccctacaccagcggcggaggcaccaagctggaaatcaaaaga

SEQ ID NO: 53 - DNA, 312 bp, Artificial Sequence
  Synthetic Polynucleotide
cagatcgtgctgacacagtctccagccacactgagcgcttctccaggcgagaaggccaccatgacatgttctgccagcagcggcgtgaactacatgcactggtatcagcagaagcccggcacaagccccaagcggtggatctacgataccgacaagacagccagcggagtgcccgccagattttctggctctggcagcggcacatcctacagcctgacaatcagcagcatggaagccgaggatgccgccacctactactgtcaccagagaggcagctacaccttcggcggaggcaccaagctggaaatcaaa

SEQ ID NO: 54 - DNA, 324 bp, Artificial Sequence
  Synthetic Polynucleotide
gacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagaga

SEQ ID NO: 55 - DNA, 336 bp, Artificial Sequence
  Synthetic Polynucleotide
gacatccagctgacccagagccccagcagcctgagcgccagcgtgggcgacagagtgaccatcacctgcaaggccagccagagcgtggactacgacggcgacagctacctgaactggtaccagcagatccccggcaaggcccccaagctgctgatctacgacgccagcaacctggtgagcggcatcccccccagattcagcggcagcggcagcggcaccgactacaccttcaccatcagcagcctgcagcccgaggacatcgccacctaccactgccagcagagcaccgaggacccctggaccttcggcggcggcaccaagctgcagatcaagaga

SEQ ID NO: 56 - DNA, 321 bp, Artificial Sequence
  Synthetic Polynucleotide
gagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaa

SEQ ID NO: 57 - DNA, 339 bp, Artificial Sequence
  Synthetic Polynucleotide
gacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcgg

SEQ ID NO: 58 - DNA, 321 bp, Artificial Sequence
  Synthetic Polynucleotide
gacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaaga

SEQ ID NO: 59 - DNA, 321 bp, Artificial Sequence
  Synthetic Polynucleotide
gagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaa

SEQ ID NO: 60 - DNA, 321 bp, Artificial Sequence
  Synthetic Polynucleotide
gagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaa

SEQ ID NO: 61 - DNA, 321 bp, Artificial Sequence
  Synthetic Polynucleotide
gacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaaga

SEQ ID NO: 62 - DNA, 318 bp, Artificial Sequence
  Synthetic Polynucleotide
gacatccagctcacacagagcccttctagcctgtctgccagcgtgggcgatagagtgaccatgacctgtagagccagcagcagcgtgtcctacatccactggttccagcagaagcctggcaaggcccctaagccttggatctacgccaccagcaatctggcctctggcgtgccagtcagattttctggcagcggctctggcaccgactacaccttcacaatatccagcctccagcctgaggacattgccacctactactgccagcagtggacctccaatcctcctacctttggcggaggcaccaagctggaaatcaaa

SEQ ID NO: 63 - DNA, 333 bp, Artificial Sequence
  Synthetic Polynucleotide
agcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgct

SEQ ID NO: 64 - DNA, 333 bp, Artificial Sequence
  Synthetic Polynucleotide
cagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgct

SEQ ID NO: 65 - DNA, 321 bp, Artificial Sequence; identical to SEQ ID NO: 61
  Synthetic Polynucleotide

SEQ ID NO: 66 - DNA, 318 bp, Artificial Sequence
  Synthetic Polynucleotide
gagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaa

SEQ ID NO: 67 - DNA, 321 bp, Artificial Sequence; identical to SEQ ID NO: 56
  Synthetic Polynucleotide

SEQ ID NO: 68 - DNA, 321 bp, Artificial Sequence
  Synthetic Polynucleotide
gagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaaga

SEQ ID NO: 69 - DNA, 339 bp, Artificial Sequence
  Synthetic Polynucleotide
gacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcgg

SEQ ID NO: 70 - DNA, 324 bp, Artificial Sequence
  Synthetic Polynucleotide
gacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcgg

SEQ ID NO: 71 - DNA, 321 bp, Artificial Sequence
  Synthetic Polynucleotide
gacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaag

SEQ ID NO: 72 - DNA, 330 bp, Artificial Sequence
  Synthetic Polynucleotide
gagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagaga

SEQ ID NO: 73 - DNA, 336 bp, Artificial Sequence
  Synthetic Polynucleotide
gacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaag

SEQ ID NO: 74 - DNA, 336 bp, Artificial Sequence
  Synthetic Polynucleotide
gacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaag

SEQ ID NO: 75 - DNA, 321 bp, Artificial Sequence
  Synthetic Polynucleotide
gacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaag

SEQ ID NO: 76 - DNA, 336 bp, Artificial Sequence
  Synthetic Polynucleotide
gacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaag

SEQ ID NO: 77 - DNA, 318 bp, Artificial Sequence
  Synthetic Polynucleotide
cagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaag

SEQ ID NO: 78 - DNA, 339 bp, Artificial Sequence
  Synthetic Polynucleotide
gagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagaga

SEQ ID NO: 79 - DNA, 342 bp, Artificial Sequence
  Synthetic Polynucleotide
gacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaag

SEQ ID NO: 80 - DNA, 333 bp, Artificial Sequence
  Synthetic Polynucleotide
gacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagcc

SEQ ID NO: 81 - DNA, 321 bp, Artificial Sequence
  Synthetic Polynucleotide
gacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaaga

SEQ ID NO: 82 - DNA, 321 bp, Artificial Sequence
  Synthetic Polynucleotide
gacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaa

SEQ ID NO: 83 - DNA, 336 bp, Artificial Sequence
  Synthetic Polynucleotide
gagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaa

SEQ ID NO: 84 - DNA, 333 bp, Artificial Sequence
  Synthetic Polynucleotide
gacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaa

SEQ ID NO: 85 - DNA, 321 bp, Artificial Sequence
  Synthetic Polynucleotide
gacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaa

SEQ ID NO: 86 - DNA, 342 bp, Artificial Sequence
  Synthetic Polynucleotide
gatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagagcc

SEQ ID NO: 87 - DNA, 339 bp, Artificial Sequence
  Synthetic Polynucleotide
gatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagaga

SEQ ID NO: 88 - DNA, 318 bp, Artificial Sequence
  Synthetic Polynucleotide
gagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaag

SEQ ID NO: 89 - DNA, 324 bp, Artificial Sequence
  Synthetic Polynucleotide
cacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagaga

SEQ ID NO: 90 - DNA, 327 bp, Artificial Sequence
  Synthetic Polynucleotide
gaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagaga

SEQ ID NO: 91 - DNA, 336 bp, Artificial Sequence
  Synthetic Polynucleotide
gacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcgg

SEQ ID NO: 92 - DNA, 339 bp, Artificial Sequence
  Synthetic Polynucleotide
gacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggc

SEQ ID NO: 93 - DNA, 339 bp, Artificial Sequence
  Synthetic Polynucleotide
gacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagaga

SEQ ID NO: 94 - DNA, 336 bp, Artificial Sequence
  Synthetic Polynucleotide
gacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaa

SEQ ID NO: 95 - DNA, 342 bp, Artificial Sequence
  Synthetic Polynucleotide
gacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaaga

SEQ ID NO: 96 - DNA, 327 bp, Artificial Sequence
  Synthetic Polynucleotide
gagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagaga

SEQ ID NO: 97 - DNA, 324 bp, Artificial Sequence
  Synthetic Polynucleotide
gacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagaga

SEQ ID NO: 98 - DNA, 327 bp, Artificial Sequence
  Synthetic Polynucleotide
gacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagaga

SEQ ID NO: 99 - DNA, 318 bp, Artificial Sequence
  Synthetic Polynucleotide
cagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaag

SEQ ID NO: 100 - DNA, 312 bp, Artificial Sequence
  Synthetic Polynucleotide
atgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagaga

SEQ ID NO: 101 - DNA, 321 bp, Artificial Sequence
  Synthetic Polynucleotide
gacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaag

SEQ ID NO: 102 - DNA, 336 bp, Artificial Sequence
  Synthetic Polynucleotide
gacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaag

SEQ ID NO: 103 - DNA, 318 bp, Artificial Sequence
  Synthetic Polynucleotide
gacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaa

SEQ ID NO: 104 - DNA, 333 bp, Artificial Sequence
  Synthetic Polynucleotide
gacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaa

SEQ ID NO: 105 - DNA, 324 bp, Artificial Sequence
  Synthetic Polynucleotide
gagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaa

SEQ ID NO: 106 - DNA, 324 bp, Artificial Sequence
  Synthetic Polynucleotide
gagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaa

SEQ ID NO: 107 - DNA, 360 bp, Artificial Sequence
  Synthetic Polynucleotide
ctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcct

SEQ ID NO: 108 - DNA, 321 bp, Artificial Sequence
  Synthetic Polynucleotide
gacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaag

SEQ ID NO: 109 - DNA, 324 bp, Artificial Sequence
  Synthetic Polynucleotide
gacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagaga

SEQ ID NO: 110 - DNA, 321 bp, Artificial Sequence
  Synthetic Polynucleotide
gacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaag

SEQ ID NO: 111 - DNA, 321 bp, Artificial Sequence
  Synthetic Polynucleotide
gacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaag

SEQ ID NO: 112 - DNA, 327 bp, Artificial Sequence
  Synthetic Polynucleotide
gacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagaga

SEQ ID NO: 113 - DNA, 339 bp, Artificial Sequence
  Synthetic Polynucleotide
gacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaa

SEQ ID NO: 114 - DNA, 339 bp, Artificial Sequence
  Synthetic Polynucleotide
gacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaa

SEQ ID NO: 115 - DNA, 339 bp, Artificial Sequence
  Synthetic Polynucleotide
gacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaa

SEQ ID NO: 116 - DNA, 321 bp, Artificial Sequence
  Synthetic Polynucleotide
gacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaa

SEQ ID NO: 117 - DNA, 324 bp, Artificial Sequence
  Synthetic Polynucleotide
gacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaa

SEQ ID NO: 118 - DNA, 339 bp, Artificial Sequence
  Synthetic Polynucleotide
cagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagct

SEQ ID NO: 119 - DNA, 339 bp, Artificial Sequence
  Synthetic Polynucleotide
cagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagct

SEQ ID NO: 120 - DNA, 321 bp, Artificial Sequence
  Synthetic Polynucleotide
gacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagaga

SEQ ID NO: 121 - DNA, 324 bp, Artificial Sequence
  Synthetic Polynucleotide
gagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagaga

SEQ ID NO: 122 - DNA, 333 bp, Artificial Sequence
  Synthetic Polynucleotide
agcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagcc

SEQ ID NO: 123 - DNA, 321 bp, Artificial Sequence
  Synthetic Polynucleotide
gacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaag

SEQ ID NO: 124 - DNA, 333 bp, Artificial Sequence
  Synthetic Polynucleotide
gacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatc

SEQ ID NO: 125 - DNA, 315 bp, Artificial Sequence
  Synthetic Polynucleotide
gacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaa

SEQ ID NO: 126 - DNA, 336 bp, Artificial Sequence
  Synthetic Polynucleotide
gatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaag

SEQ ID NO: 127 - DNA, 321 bp, Artificial Sequence
  Synthetic Polynucleotide
gagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcag

SEQ ID NO: 128 - DNA, 339 bp, Artificial Sequence
  Synthetic Polynucleotide
gagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaag

SEQ ID NO: 129 - DNA, 336 bp, Artificial Sequence
  Synthetic Polynucleotide
gacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaag

SEQ ID NO: 130 - DNA, 336 bp, Artificial Sequence
  Synthetic Polynucleotide
gacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaag

SEQ ID NO: 131 - DNA, 330 bp, Artificial Sequence
  Synthetic Polynucleotide
tctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttgga

SEQ ID NO: 132 - DNA, 321 bp, Artificial Sequence
  Synthetic Polynucleotide
gacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaag

SEQ ID NO: 133 - DNA, 309 bp, Artificial Sequence
  Synthetic Polynucleotide
tacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaa

SEQ ID NO: 134 - DNA, 336 bp, Artificial Sequence
  Synthetic Polynucleotide
gacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagagg

SEQ ID NO: 135 - DNA, 327 bp, Artificial Sequence
  Synthetic Polynucleotide
ctggaaaccaccctgacacagagccctgccaccctgagtgtgtccccaggcgagagagtgaccctgagctgtagagccagccagagcgtgggcagcaacctggcctggtatcagcagaagttcggccaggcccccagactgctgatctacgacgccagcacaagagccaccggcatccccgccagattttctggcagcggctccggcaccgagttcaccctgaccatcagcagactggaacccgaggacttcgccgtgtactactgccaccagtacggcagcagccccagaacctttggacagggcaccaaggtggacatcaagcgg

SEQ ID NO: 136 - DNA, 339 bp, Artificial Sequence
  Synthetic Polynucleotide
gacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaag

SEQ ID NO: 137 - DNA, 315 bp, Artificial Sequence
  Synthetic Polynucleotide
gagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagagg

SEQ ID NO: 138 - DNA, 324 bp, Artificial Sequence
  Synthetic Polynucleotide
gacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagaga

SEQ ID NO: 139 - DNA, 333 bp, Artificial Sequence
  Synthetic Polynucleotide
cagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatcccgagcgtgcaggccgacgacgaggccggatatgtgtgcggcgctgacgacaatggcggctacgtgttcggcggaggcacccaactgacagtgaca

SEQ ID NO: 140 - DNA, 333 bp, Artificial Sequence
  Synthetic Polynucleotide
cagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgaca

SEQ ID NO: 141 - DNA, 333 bp, Artificial Sequence
  Synthetic Polynucleotide
cagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgaca

SEQ ID NO: 142 - DNA, 321 bp, Artificial Sequence
  Synthetic Polynucleotide
gacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaag

SEQ ID NO: 143 - DNA, 321 bp, Artificial Sequence; identical to SEQ ID NO: 75
  Synthetic Polynucleotide

SEQ ID NO: 144 - DNA, 336 bp, Artificial Sequence
  Synthetic Polynucleotide
aacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacag

SEQ ID NO: 145 - DNA, 321 bp, Artificial Sequence
  Synthetic Polynucleotide
aacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagaga

SEQ ID NO: 146 - DNA, 336 bp, Artificial Sequence
  Synthetic Polynucleotide
gacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaag

SEQ ID NO: 147 - DNA, 321 bp, Artificial Sequence
  Synthetic Polynucleotide
gacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagaga

SEQ ID NO: 148 - DNA, 333 bp, Artificial Sequence
  Synthetic Polynucleotide
cagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggt

SEQ ID NO: 149 - DNA, 333 bp, Artificial Sequence
  Synthetic Polynucleotide
cagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggt

SEQ ID NO: 150 - DNA, 339 bp, Artificial Sequence
  Synthetic Polynucleotide
cagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttgga

SEQ ID NO: 151 - DNA, 333 bp, Artificial Sequence
  Synthetic Polynucleotide
cagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttgga

SEQ ID NO: 152 - DNA, 321 bp, Artificial Sequence
  Synthetic Polynucleotide
gacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagaga

SEQ ID NO: 153 - DNA, 315 bp, Artificial Sequence
  Synthetic Polynucleotide
gacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcct

SEQ ID NO: 154 - DNA, 321 bp, Artificial Sequence
  Synthetic Polynucleotide
cagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtct

SEQ ID NO: 155 - DNA, 315 bp, Artificial Sequence
  Synthetic Polynucleotide
cagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctg

SEQ ID NO: 156 - DNA, 312 bp, Artificial Sequence
  Synthetic Polynucleotide
gagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaaga

SEQ ID NO: 157 - DNA, 321 bp, Artificial Sequence
  Synthetic Polynucleotide
gagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatc

SEQ ID NO: 158 - DNA, 324 bp, Artificial Sequence
  Synthetic Polynucleotide
gacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagaga

SEQ ID NO: 159 - DNA, 324 bp, Artificial Sequence
  Synthetic Polynucleotide
gacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagaga

SEQ ID NO: 160 - DNA, 339 bp, Artificial Sequence
  Synthetic Polynucleotide
agctacgagctgacacagcctccatccgtgtctggcacacctggacagagagtggctatctcctgtagcggcagcagcagcaacatcggcaccagaatggtcacctggtatcagcacgtgccaggcacagcccctaagctgctgatcttcaacaacaaccagcggcctagcggcgtgcccgatagattttctgccagcaagagcggcacaagcgccagcctggctatcatcggactccagtctgacgacgaggccgactactactgtgccacctgggacgacaacgtgaagtcctacgtgttcggcaccggcaccaaagtgacagtgcttggaagtaga

SEQ ID NO: 161 - DNA, 330 bp, Artificial Sequence
  Synthetic Polynucleotide
cagtctgtgctgacacagcctcctagcctgtctgtggcccctggaaagacagccagcatcacatgcggcggcaacaacatcggcatgaagtccgtgcactggtatcagcagaggccaggacaggctcctgtgctggtcatctactacgacagcgacagaccctctggcatccccggcagattttccggcagcaactctggcaataccgccacactgaccatctccagagtggaagctggcgacgaggccgactactactgccaagtgtgggataccaccggcgatcaccctggctatgtgtttggcaccggcaccaaagtgacagtgctt

SEQ ID NO: 162 - DNA, 327 bp, Artificial Sequence
  Synthetic Polynucleotide
gagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagaga

SEQ ID NO: 163 - DNA, 339 bp, Artificial Sequence
  Synthetic Polynucleotide
gagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcgg

SEQ ID NO: 164 - DNA, 291 bp, Artificial Sequence
  Synthetic Polynucleotide
gacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaa

SEQ ID NO: 165 - DNA, 327 bp, Artificial Sequence
  Synthetic Polynucleotide
gacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagaga

SEQ ID NO: 166 - DNA, 321 bp, Artificial Sequence
  Synthetic Polynucleotide
gacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaag

SEQ ID NO: 167 - DNA, 357 bp, Artificial Sequence
  Synthetic Polynucleotide
caggtgcagctccaggagagtggcccaggacttgtgaagccaagtgaaactctctcactcacttgtgctgtgagtggatacagtatcagtgacgatcacgctgtcagctgggtacgacaacctcccggagagggtctggagtggatcggtttcatttcctatagtggcattacaaactacaaccccacacttcaggaccgcgtcacaatttcacgggacaattccaagaacaccctgtatctccagatgaatagtctgagggcagaggatacggctgtgtactactgtgcccggctgctcgcccgcgcaacagctatggacgtgtggggtgaggggaccctggtgaccgtaagttcc

SEQ ID NO: 168 - DNA, 309 bp, Artificial Sequence
  Synthetic Polynucleotide
gacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaa

SEQ ID NO: 169 - DNA, 318 bp, Artificial Sequence
  Synthetic Polynucleotide
atccaaatgacacaatcttcatcctacttgtctgtttctctaggaggcagagtcaccatcacttgcaaggcaagtgcccacatcaataattggttagcctggtatcagcagaaaccaggaaatgctcctagactcttaatatctggtgcaaccagtttggaaactggggttccttcaagattcagtggcagtggatctggaaaggattacactctcagcattaacagtcttcagactgaagatgttgctacttattattgtcaacagtattggagtcttcctcggacgttcggtggaggcaccaggctggaaatcaaa

SEQ ID NO: 170 - DNA, 339 bp, Artificial Sequence
  Synthetic Polynucleotide
gacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaag

SEQ ID NO: 171 - DNA, 324 bp, Artificial Sequence
  Synthetic Polynucleotide
gacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagaga

SEQ ID NO: 172 - DNA, 321 bp, Artificial Sequence
  Synthetic Polynucleotide
gacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagaga

SEQ ID NO: 173 - DNA, 321 bp, Artificial Sequence
  Synthetic Polynucleotide
gacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaag

SEQ ID NO: 174 - DNA, 336 bp, Artificial Sequence
  Synthetic Polynucleotide
gacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcacc

SEQ ID NO: 175 - DNA, 321 bp, Artificial Sequence
  Synthetic Polynucleotide
gacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcga

SEQ ID NO: 176 - DNA, 321 bp, Artificial Sequence
  Synthetic Polynucleotide
gacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaa

SEQ ID NO: 177 - DNA, 348 bp, Artificial Sequence
  Synthetic Polynucleotide
gaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaag

SEQ ID NO: 178 - DNA, 345 bp, Artificial Sequence
  Synthetic Polynucleotide
gaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaag

SEQ ID NO: 179 - DNA, 324 bp, Artificial Sequence
  Synthetic Polynucleotide
gacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagaga

SEQ ID NO: 180 - DNA, 324 bp, Artificial Sequence
  Synthetic Polynucleotide
gacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagaga

SEQ ID NO: 181 - DNA, 321 bp, Artificial Sequence
  Synthetic Polynucleotide
gatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaac

SEQ ID NO: 182 - DNA, 321 bp, Artificial Sequence
  Synthetic Polynucleotide
gacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaac

SEQ ID NO: 183 - DNA, 318 bp, Artificial Sequence
  Synthetic Polynucleotide
cagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaa

SEQ ID NO: 184 - DNA, 336 bp, Artificial Sequence
  Synthetic Polynucleotide
gacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaa

SEQ ID NO: 185 - DNA, 336 bp, Artificial Sequence
  Synthetic Polynucleotide
gacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaa

SEQ ID NO: 186 - DNA, 345 bp, Artificial Sequence
  Synthetic Polynucleotide
tcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgca

SEQ ID NO: 187 - DNA, 333 bp, Artificial Sequence
  Synthetic Polynucleotide
gacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaag

SEQ ID NO: 188 - DNA, 327 bp, Artificial Sequence
  Synthetic Polynucleotide
gagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagaga

SEQ ID NO: 189 - DNA, 324 bp, Artificial Sequence
  Synthetic Polynucleotide
gagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcgg

SEQ ID NO: 190 - DNA, 339 bp, Artificial Sequence
  Synthetic Polynucleotide
gacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagaga

SEQ ID NO: 191 - DNA, 327 bp, Artificial Sequence
  Synthetic Polynucleotide
gagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagaga

SEQ ID NO: 192 - DNA, 336 bp, Artificial Sequence
  Synthetic Polynucleotide
gacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaag

SEQ ID NO: 193 - DNA, 330 bp, Artificial Sequence
  Synthetic Polynucleotide
gaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctg

SEQ ID NO: 194 - DNA, 291 bp, Artificial Sequence
  Synthetic Polynucleotide
gagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcgaggacttcgccgtgtactactgccagcagagcaccttcggccagggcaccaaggtggaaatcaag

SEQ ID NO: 195 - DNA, 321 bp, Artificial Sequence
  Synthetic Polynucleotide
gagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacctttggacagggcaccaaggtggaaatcaag

SEQ ID NO: 196 - DNA, 321 bp, Artificial Sequence
  Synthetic Polynucleotide
gacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaa

SEQ ID NO: 197 - DNA, 324 bp, Artificial Sequence
  Synthetic Polynucleotide
gacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagaga

SEQ ID NO: 198 - DNA, 336 bp, Artificial Sequence
  Synthetic Polynucleotide
gccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttaga

SEQ ID NO: 199 - DNA, 324 bp, Artificial Sequence
  Synthetic Polynucleotide
gacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaag

SEQ ID NO: 200 - DNA, 318 bp, Artificial Sequence
  Synthetic Polynucleotide
cagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcgg

SEQ ID NO: 201 - DNA, 339 bp, Artificial Sequence
  Synthetic Polynucleotide
gacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagaga

SEQ ID NO: 202 - DNA, 321 bp, Artificial Sequence
  Synthetic Polynucleotide
gacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaag

SEQ ID NO: 203 - DNA, 321 bp, Artificial Sequence
  Synthetic Polynucleotide
gacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaag

SEQ ID NO: 204 - DNA, 309 bp, Artificial Sequence
  Synthetic Polynucleotide
gacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagaga

SEQ ID NO: 205 - DNA, 324 bp, Artificial Sequence
  Synthetic Polynucleotide
gacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagaga

SEQ ID NO: 206 - DNA, 321 bp, Artificial Sequence
  Synthetic Polynucleotide
gacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaa

SEQ ID NO: 207 - DNA, 324 bp, Artificial Sequence
  Synthetic Polynucleotide
gacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaa

SEQ ID NO: 208 - DNA, 321 bp, Artificial Sequence
  Synthetic Polynucleotide
cagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctg

SEQ ID NO: 209 - DNA, 324 bp, Artificial Sequence
  Synthetic Polynucleotide
gagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaag

SEQ ID NO: 210 - DNA, 318 bp, Artificial Sequence
  Synthetic Polynucleotide
gagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaa

SEQ ID NO: 211 - DNA, 324 bp, Artificial Sequence
  Synthetic Polynucleotide
gacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagaga

SEQ ID NO: 212 - DNA, 339 bp, Artificial Sequence
  Synthetic Polynucleotide
gacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcgg

SEQ ID NO: 213 - DNA, 327 bp, Artificial Sequence
  Synthetic Polynucleotide
agctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacag

SEQ ID NO: 214 - DNA, 339 bp, Artificial Sequence
  Synthetic Polynucleotide
aacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacag

SEQ ID NO: 215 - DNA, 324 bp, Artificial Sequence
  Synthetic Polynucleotide
gacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagaga

SEQ ID NO: 216 - DNA, 327 bp, Artificial Sequence
  Synthetic Polynucleotide
gagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagaga

SEQ ID NO: 217 - DNA, 324 bp, Artificial Sequence
  Synthetic Polynucleotide
gacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaaga

SEQ ID NO: 218 - DNA, 321 bp, Artificial Sequence; identical to SEQ ID NO: 196
  Synthetic Polynucleotide

SEQ ID NO: 219 - DNA, 321 bp, Artificial Sequence
  Synthetic Polynucleotide
gagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaag

SEQ ID NO: 220 - DNA, 342 bp, Artificial Sequence
  Synthetic Polynucleotide
gacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagaga

SEQ ID NO: 221 - DNA, 321 bp, Artificial Sequence
  Synthetic Polynucleotide
gagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaag

SEQ ID NO: 222 - DNA, 324 bp, Artificial Sequence
  Synthetic Polynucleotide
gacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagaga

SEQ ID NO: 223 - DNA, 339 bp, Artificial Sequence
  Synthetic Polynucleotide
gacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagcggcaccgacttcaccctgaccatcagttctcttcaggccgaggacgtggccgtgtactactgccagaacgactacagctaccccctgaccttcggccagggcaccaaggtggaaatcaag

SEQ ID NO: 224 - DNA, 321 bp, Artificial Sequence
  Synthetic Polynucleotide
gacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaag

SEQ ID NO: 225 - DNA, 333 bp, Artificial Sequence
  Synthetic Polynucleotide
gacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaag

SEQ ID NO: 226 - DNA, 327 bp, Artificial Sequence
  Synthetic Polynucleotide
gccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagaga

SEQ ID NO: 227 - DNA, 321 bp, Artificial Sequence
  Synthetic Polynucleotide
cagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctg

SEQ ID NO: 228 - DNA, 321 bp, Artificial Sequence
  Synthetic Polynucleotide
gacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaag

SEQ ID NO: 229 - DNA, 324 bp, Artificial Sequence
  Synthetic Polynucleotide
gacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcgg

SEQ ID NO: 230 - DNA, 339 bp, Artificial Sequence
  Synthetic Polynucleotide
gagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcgg

SEQ ID NO: 231 - DNA, 339 bp, Artificial Sequence
  Synthetic Polynucleotide
gacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcgg

SEQ ID NO: 232 - DNA, 339 bp, Artificial Sequence
  Synthetic Polynucleotide
gacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagaga

SEQ ID NO: 233 - DNA, 321 bp, Artificial Sequence
  Synthetic Polynucleotide
gagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaag

SEQ ID NO: 234 - DNA, 330 bp, Artificial Sequence
  Synthetic Polynucleotide
caggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctg

SEQ ID NO: 235 - DNA, 321 bp, Artificial Sequence
  Synthetic Polynucleotide
gacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagaga

SEQ ID NO: 236 - DNA, 333 bp, Artificial Sequence
  Synthetic Polynucleotide
cagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggt

SEQ ID NO: 237 - DNA, 327 bp, Artificial Sequence
  Synthetic Polynucleotide
cagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggt

SEQ ID NO: 238 - DNA, 327 bp, Artificial Sequence
  Synthetic Polynucleotide
caggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctg

SEQ ID NO: 239 - DNA, 324 bp, Artificial Sequence
  Synthetic Polynucleotide
gagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagaga

SEQ ID NO: 240 - DNA, 324 bp, Artificial Sequence
  Synthetic Polynucleotide
gagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaa

SEQ ID NO: 241 - DNA, 321 bp, Artificial Sequence
  Synthetic Polynucleotide
gacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaa

SEQ ID NO: 242 - DNA, 318 bp, Artificial Sequence
  Synthetic Polynucleotide
gacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaa

SEQ ID NO: 243 - DNA, 318 bp, Artificial Sequence
  Synthetic Polynucleotide
gacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaa

SEQ ID NO: 244 - DNA, 324 bp, Artificial Sequence
  Synthetic Polynucleotide
gacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagaga

SEQ ID NO: 245 - DNA, 336 bp, Artificial Sequence
  Synthetic Polynucleotide
gacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagaga

SEQ ID NO: 246 - DNA, 321 bp, Artificial Sequence
  Synthetic Polynucleotide
gacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaa

SEQ ID NO: 247 - DNA, 321 bp, Artificial Sequence
  Synthetic Polynucleotide
gagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaa

SEQ ID NO: 248 - DNA, 321 bp, Artificial Sequence
  Synthetic Polynucleotide
gagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaa

SEQ ID NO: 249 - DNA, 324 bp, Artificial Sequence
  Synthetic Polynucleotide
gacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagaga

SEQ ID NO: 250 - DNA, 339 bp, Artificial Sequence
  Synthetic Polynucleotide
gaactggttatgacacagagccccagcagcctgacagtgacagccggcgagaaagtgaccatgatctgcaagtctagccagagcctgctgaactccggcgatcagaagaactacctgacctggtatcagcagaaacccggccagcctcctaagctgctgatcttctgggccagcaccagagaaagcggcgtgcccgatagattcacaggcagcggcagcggaaccgacttcaccctgacaatcagctctgtgcaggccgaggacctggccgtgtattactgccagaacgactacagctaccctctgacctttggagccggcaccaagctggaactgaag

SEQ ID NO: 251 - DNA, 372 bp, Artificial Sequence
  Synthetic Polynucleotide
gacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcct

SEQ ID NO: 252 - DNA, 324 bp, Artificial Sequence
  Synthetic Polynucleotide
gagatcgtgctgacacagtctcccgccacactgtcactgtctccaggcgaaagagccacactgagctgtagagccagccagagcgtgtccatctacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcctcctttcacattcggccctggcaccaaggtggacatcaaa

SEQ ID NO: 253 - DNA, 321 bp, Artificial Sequence; identical to SEQ ID NO: 196
  Synthetic Polynucleotide

SEQ ID NO: 254 - DNA, 324 bp, Artificial Sequence
  Synthetic Polynucleotide
ctgcctgttctgacacagcctccatccgtgtctgtggcccctggaaagaccgccagaatcacatgcggcggcaacaacatcggcagcaagagcgtgcactggtatcagcagaagcctggacaggctcctgtgctggtggtgtacgacgacagcgatagacctagcggcatccccgagagattcagcggcagcaattccggcaataccgccacactgaccatcagcagagtggaagctggcgacgaggccgactactactgccaagtgtgggacagcagcagcgactacgtggtgtttggcggcggaacaaagctgacagtgctt

SEQ ID NO: 255 - DNA, 333 bp, Artificial Sequence
  Synthetic Polynucleotide
cagtctgtgctgacacagcctcctagtgtgtctggcgctcctggacagagagtgaccatcagctgtacaggcagcagcagcaatatcggagccggctatgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctctgtgtttggcacaggcacaaaggtgctggtgctt

SEQ ID NO: 256 - DNA, 336 bp, Artificial Sequence
  Synthetic Polynucleotide
aacttcatgctgacccagcctcacagcgtgtccgagtctccaggcaagaccgtgaccatcagctgtacaggcagcagcggctctatcgccagcaactacgtgcagtggtatcagcagaggccaggcagcgcccctaccatcctgatctacgaggataacaagcggcctagcggcgtgcccgatagattttctggcagcatcgacagcagcagcaacagcgccagcctgacaatcagcggcctgaaaacaggcgacgaggccgactactactgccagagctacgacgacatcaaccactgggttttcggcggaggcaccaagctgacagttcttgga

SEQ ID NO: 257 - DNA, 318 bp, Artificial Sequence
  Synthetic Polynucleotide
cagatcgtgctgacacagagccctgccatcatgtccgcttctcccggcgagaaagtgaccatcacatgtagcgccagcagcagcgtgtcctacatgcactggttccagcagaagcccggcacaagccctaagctgtggatctacagcaccagcaatctggcctctggcgtgccagccagattttctggctctggcagcggcaccagctacagcctgacaatcagcagaatggaagccgaggacgccgccacctactactgtcagcagagaagcagctaccctcctacctttggcggaggcaccaagctggaaatcaaa

SEQ ID NO: 258 - DNA, 339 bp, Artificial Sequence
  Synthetic Polynucleotide
gacatcgtgatgacacagagccctagcagcctgacagtgacagccggcgagaaagtgaccatgagctgcaagagcagccagagcctgctgaacagcggcaaccagaagaactacctgacctggtatcagcagaagcccggccagcctcctaagctgctgatctactgggccagcaccagagaaagcggcgtgcccgatagattcacaggcagcggcagcggaaccgacttcaccctgacaatcagctctgtgcaggccgaggatctggccgtgtactactgccagaacgactacagctaccccttcacctttggctccggcaccaagctggaaatcaaa

SEQ ID NO: 259 - DNA, 321 bp, Artificial Sequence
  Synthetic Polynucleotide
gacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaa

SEQ ID NO: 260 - DNA, 339 bp, Artificial Sequence
  Synthetic Polynucleotide
gacatcgtgatgacacagagccctagcagcctggctatgagcgtgggccagaaagtgaccatgacctgcaagagcagccagagcctgctgaacagcagcaaccagaagaactacctggcctggtatcagcagaagcccggacagtctcctaagctgctggtgtactttgccagcaccagagaaagcggcgtgcccgacagattcatcggctctggaagcggcaccgacttcaccctgacaatcagctctgtgcaggccgaggacctggccgattacttctgtcaccagcactacagcacccctctgacctttggagccggcaccaagctggaactgaaa

SEQ ID NO: 261 - DNA, 333 bp, Artificial Sequence
  Synthetic Polynucleotide
cagtctgtggtcacacagcctccatccgtgtctgctgcccctggacagaaagtgaccatcagctgtagcggcagcagcagcaacatcggcaacaactacgtgtcctggtatcagcagctgcccggcacagctcccaaactgctgatctacgacaacaacaagcggcccagcggcatccccgatagattttctgccagcaagagcggcaccagcgccacactgggaatcacaggactccagaccagagatgaggccgactactactgcggcacctgggattcttctctgtccgcctgggttttcggcggaggcacaaaactgacagtgctcgga

SEQ ID NO: 262 - DNA, 336 bp, Artificial Sequence
  Synthetic Polynucleotide
gatgttctgatgacccagacacctctgagcctgcctgtgtctctgggcgatcaggccagcatctcctgtagaagcagccagagcatcgtgcacagaaccggcaacacctacctggaatggtatctccagaagcctgggcagagccccaagctgctgatctacaaggtgtccaacagattcagcggcgtgcccgacagattttctggcagcggctctggcaccgacttcaccctgaagattagcagagtgggagccgaggacctgggcgtctactactgctttcaaggcagccacgtgccatacacctttggcggaggcaccaagctggaaatcaag

SEQ ID NO: 263 - DNA, 333 bp, Artificial Sequence
  Synthetic Polynucleotide
gagctggtcatgacacagagccctgcttctctggccgtgtcactgggacagagagccaccatctcttgcagagccagcgagagcgtggacagctacggcaagagcttcatgcactggtatcagctcaagcccggccagcctcctaagctgctgatctacagagcctccaacctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaagctggaaatcaaa

SEQ ID NO: 264 - DNA, 336 bp, Artificial Sequence; identical to SEQ ID NO: 23
  Synthetic Polynucleotide

SEQ ID NO: 265 - DNA, 336 bp, Artificial Sequence
  Synthetic Polynucleotide
gatattgtgctgactcagagccctgccactctgagccttagtccaggcgacagagctaccatctcctgtagggcctctgaatccgtgaccattctgggctctcatctcatatattggtatcaacaaaagccgggccagcctccacggctgctcattcaactggcctctaacgtgcagaccggcgtgccagctagattttctggctctggctcccggaccgactttacactgacaatcagctccgtggaacccgaagattttgccgtctattattgcctccagtccaggaccattcctcggacattcggccagggaacaaaactcgaaatcaagcgg

SEQ ID NO: 266 - DNA, 321 bp, Artificial Sequence
  Synthetic Polynucleotide
gacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaa

SEQ ID NO: 267 - DNA, 339 bp, Artificial Sequence
  Synthetic Polynucleotide
gacgtgctgatgacccagacacctgtgtctctgtccgtgtctctgggagatcaggccagcatctcctgtagaagcagccagagcatcgtgcacagcaccggcaacacctacctggaatggtatctccagaagcctggacagagccccaagctgctgatctacaagatcagcaacagattcagcggcgtgcccgacagattttctggcagcggctctggcaccgacttcaccctgaagattagcagagtggaagccgaggacctgggcgtgtactactgcttccaagcctctcacgcccctagaacctttggcggaggcaccaagctggaaatcaagaga

SEQ ID NO: 268 - DNA, 318 bp, Artificial Sequence
  Synthetic Polynucleotide
tcttctgagctgacacaggaccctgccgtgtctgttgctctgggccagacagtgcggattacctgtcagggcgatagcctgagaagctactacgcctcctggtatcagcagaagccaggccaggctcctgtgctggtcatctacggcaagaacaacagacccagcggcatccccgatagattcagcggaagcagctctggcaataccgccagcctgacaattactggcgctcaggccgaggacgaggccgactactactgcaacagcagagatagcagcggctgggttttcggcggaggcacaaaactgacagtgctg

SEQ ID NO: 269 - DNA, 336 bp, Artificial Sequence
  Synthetic Polynucleotide
caatctgctctgacacagcctgccagcgtgtcaggatctcctggacagagcatcaccatctcttgcaccggcaccagctctgatgtcggcggctacaattacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactggtgtacgtgttcggcacaggcaccaaagtgaccgtgctt

SEQ ID NO: 270 - DNA, 330 bp, Artificial Sequence
  Synthetic Polynucleotide
caatctgtgctgacccagcctagatccgtgtctggctctcctggacagagcgtgaccatctcttgtaccggcaccagctctgatgtcggcggctacaattacgtgtcctggtatcagcagcaccccggcgaagcccctaagctgattatctacgacgccgacaagcggcccagcggcatcagcaatagattcagctctggcaagagcggcaacaccgccagcctgacaatcagcggactccaggtggaagatgaggccgactactactgctgctcctatgccggcggaagcacctgggttttcggaggcggtacaaaagtgaccgtgctg

SEQ ID NO: 271 - DNA, 336 bp, Artificial Sequence
  Synthetic Polynucleotide
caatctgctctgacacagcctgccagcgtgtcaggatctcctggacagagcatcaccatctcttgcaccggcaccagctctgatgtcggcggctacaattacgtgtcctggtatcagcagcaccccggcaaggcccctaaagtgattatcagcgaagtgaacaacagacccagcggcgtgtcccacagattcagcggctctaagtctggcaacaccgccagcctgacaatctctggactgcaagccgaggacgaggccgactacttctgtagcagctacaccagcggcagaaccctgtacgtgttcggcacaggcagcaaagtgacagtgctggga

SEQ ID NO: 272 - DNA, 381 bp, Artificial Sequence
  Synthetic Polynucleotide
gaagtgcagctccagcagtctggacctggcctggttaagcctagccagacactgagcctgacctgtgccatcagcggcgattccatgctgagcaacagcgacacctggaactggatcagacagagccccagcagaggcctggaatggctgggcagaacataccacagaagcacttggtacgacgactacgccagctctgtgcggggcagagtgtccatcaatgtggacaccagcaagaaccagtacagcctgcaactgaacgccgtgacacctgaggataccggcgtgtactactgtgccagagtgcggctccaggacggcaattcttggagcgacgcctttgatgtgtggggccagggcacaatggtcaccgtttctagc

SEQ ID NO: 273 - DNA, 321 bp, Artificial Sequence
  Synthetic Polynucleotide
gacgtggtcatgacacagagcccttctagcctgtctgccagcgtgggcgacagagtgaccatcacatgtagagccagccaggacatcagcaagtacctgaactggtatcagcagaagcccggcaaggcccctaagctgctgatctaccacaccagcagactgcacagcggcgtgccaagcagattttctggcagcggctctggcaccgacttcaccctgacaatatccagcctccagcctgaggacttcgccacctactattgccagcagggcaacaccctgccttacacctttggcggcggaacaaaggtggaaatcaaa

SEQ ID NO: 274 - DNA, 327 bp, Artificial Sequence
  Synthetic Polynucleotide
gagatcgtgctgacacagtctcccgccacactgtcactgtctccaggcgaaagagccacactgagctgtagcgccagcagcagcgtgtcctacatgtactggtatcagcagaagcccggacaggcccctagactgctgatctacagaaccagcaacctggcctctggcatccccgccagattttctggctctggcagcggcaccgatttcaccctgaccataagcagcctggaacctgaggacttcgccgtgtactactgccagcagtaccacagctaccccaccacctttggacagggcaccaaggtggaaatcaagcggacagtt

SEQ ID NO: 275 - DNA, 321 bp, Artificial Sequence
  Synthetic Polynucleotide
gacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaa

SEQ ID NO: 276 - DNA, 324 bp, Artificial Sequence
  Synthetic Polynucleotide
gacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagaga

SEQ ID NO: 277 - DNA, 324 bp, Artificial Sequence
  Synthetic Polynucleotide
gacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagaga

SEQ ID NO: 278 - DNA, 45 bp, Artificial Sequence
  Synthetic Polynucleotide
ggcggaggcggaagtggaggcggaggatctggcggcggaggctct

SEQ ID NO: 279 - DNA, 45 bp, Artificial Sequence
  Synthetic Polynucleotide
ggaggcggaggaagtggcggcggaggatctgggggaggcggaagc

SEQ ID NO: 280 - DNA, 45 bp, Artificial Sequence
  Synthetic Polynucleotide
ggtggcggtggctcgggcggtggtgggtcgggtggcggcggatct

SEQ ID NO: 281 - DNA, 45 bp, Artificial Sequence
  Synthetic Polynucleotide
ggcggcggaggatctggcggaggcggatctgggggcggaggctct

SEQ ID NO: 282 - DNA, 45 bp, Artificial Sequence
  Synthetic Polynucleotide
ggcggtggcggttcaggtggagggggaagcggtggtggtggctca

SEQ ID NO: 283 - DNA, 45 bp, Artificial Sequence
  Synthetic Polynucleotide
ggcggcggaggctcaggcggaggcggatctggcgggggaggatct

SEQ ID NO: 284 - DNA, 105 bp, Artificial Sequence
  Synthetic Polynucleotide
ggaggtagcggctccgggggaggcggaagtggaggcggaggatctgggtctggaggaagcggatctggaggctcagggtcagggggctcaggcagtggaggctct

SEQ ID NO: 285 - DNA, 105 bp, Artificial Sequence
  Synthetic Polynucleotide
ggaggaggcggctccgggggaggcggaagtggaggcggaggatctgggtctggaggaagcggatctggaggctcagggtcagggggctcaggcagtggaggctct

SEQ ID NO: 286 - DNA, 75 bp, Artificial Sequence
  Synthetic Polynucleotide
agcagcgccgacgacgccaagaaggacgccgccaaaaaggatgatgccaagaaagacgatgctaaaaaagacggc

SEQ ID NO: 287 - DNA, 120 bp, Artificial Sequence
  Synthetic Polynucleotide
ggctcagcatggtctcatcctcagtttgaaaaaggtggagggtccgggggcggcagtggtggtagtgcttggtcccatccacagtttgaaaagtcgcgttcctccggaggtggtggctcc

SEQ ID NO: 288 - DNA, 21 bp, Artificial Sequence
  Synthetic Polynucleotide
cctggcggaggcgggtctcct

SEQ ID NO: 289 - DNA, 21 bp, Artificial Sequence
  Synthetic Polynucleotide
cctggtggcggaggatctcct

SEQ ID NO: 290 - DNA, 21 bp, Artificial Sequence
  Synthetic Polynucleotide
gaggttgcggcgctcgaaagg

SEQ ID NO: 291 - DNA, 21 bp, Artificial Sequence
  Synthetic Polynucleotide
cgtgtggctgcgctcaaggag

SEQ ID NO: 292 - DNA, 15 bp, Artificial Sequence
  Synthetic Polynucleotide
gaggccgcagcaaag

SEQ ID NO: 293 - DNA, 15 bp, Artificial Sequence
  Synthetic Polynucleotide
gaagcagccgccaag

SEQ ID NO: 294 - DNA, 351 bp, Artificial Sequence
  Synthetic Polynucleotide
gaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagt

SEQ ID NO: 295 - DNA, 372 bp, Artificial Sequence
  Synthetic Polynucleotide
gaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatct

SEQ ID NO: 296 - DNA, 378 bp, Artificial Sequence
  Synthetic Polynucleotide
caaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttct

SEQ ID NO: 297 - DNA, 375 bp, Artificial Sequence
  Synthetic Polynucleotide
gggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctct

SEQ ID NO: 298 - DNA, 360 bp, Artificial Sequence
  Synthetic Polynucleotide
gctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagt

SEQ ID NO: 299 - DNA, 369 bp, Artificial Sequence
  Synthetic Polynucleotide
gaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctcc

SEQ ID NO: 300 - DNA, 354 bp, Artificial Sequence
  Synthetic Polynucleotide
caagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatct

SEQ ID NO: 301 - DNA, 351 bp, Artificial Sequence
  Synthetic Polynucleotide
gaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatct

SEQ ID NO: 302 - DNA, 351 bp, Artificial Sequence
  Synthetic Polynucleotide
caggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctct

SEQ ID NO: 303 - DNA, 363 bp, Artificial Sequence
  Synthetic Polynucleotide
caggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagc

SEQ ID NO: 304 - DNA, 375 bp, Artificial Sequence
  Synthetic Polynucleotide
cttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatct

SEQ ID NO: 305 - DNA, 351 bp, Artificial Sequence
  Synthetic Polynucleotide
caagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttct

SEQ ID NO: 306 - DNA, 351 bp, Artificial Sequence
  Synthetic Polynucleotide
caagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagt

SEQ ID NO: 307 - DNA, 354 bp, Artificial Sequence
  Synthetic Polynucleotide
caggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctct

SEQ ID NO: 308 - DNA, 360 bp, Artificial Sequence
  Synthetic Polynucleotide
gaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagc

SEQ ID NO: 309 - DNA, 354 bp, Artificial Sequence
  Synthetic Polynucleotide
cagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttct

SEQ ID NO: 310 - DNA, 360 bp, Artificial Sequence
  Synthetic Polynucleotide
gaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctct

SEQ ID NO: 311 - DNA, 360 bp, Artificial Sequence
  Synthetic Polynucleotide
caagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctct

SEQ ID NO: 312 - DNA, 354 bp, Artificial Sequence
  Synthetic Polynucleotide
gaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagt

SEQ ID NO: 313 - DNA, 354 bp, Artificial Sequence
  Synthetic Polynucleotide
caagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttct

SEQ ID NO: 314 - DNA, 357 bp, Artificial Sequence
  Synthetic Polynucleotide
caagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttct

SEQ ID NO: 315 - DNA, 357 bp, Artificial Sequence
  Synthetic Polynucleotide
gaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttct

SEQ ID NO: 316 - DNA, 345 bp, Artificial Sequence
  Synthetic Polynucleotide
caagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagt

SEQ ID NO: 317 - DNA, 357 bp, Artificial Sequence
  Synthetic Polynucleotide
caagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttct

SEQ ID NO: 318 - DNA, 357 bp, Artificial Sequence
  Synthetic Polynucleotide
gaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagt

SEQ ID NO: 319 - DNA, 363 bp, Artificial Sequence
  Synthetic Polynucleotide
gaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctct

SEQ ID NO: 320 - DNA, 375 bp, Artificial Sequence
  Synthetic Polynucleotide
caggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttct

SEQ ID NO: 321 - DNA, 366 bp, Artificial Sequence
  Synthetic Polynucleotide
caggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagc

SEQ ID NO: 322 - DNA, 354 bp, Artificial Sequence
  Synthetic Polynucleotide
gaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctct

SEQ ID NO: 323 - DNA, 363 bp, Artificial Sequence
  Synthetic Polynucleotide
gaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctct

SEQ ID NO: 324 - DNA, 360 bp, Artificial Sequence
  Synthetic Polynucleotide
caggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagt

SEQ ID NO: 325 - DNA, 360 bp, Artificial Sequence
  Synthetic Polynucleotide
caggtgcagctccaggaatctggccctggcctcgtgaagcctagtcagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagt

SEQ ID NO: 326 - DNA, 372 bp, Artificial Sequence
  Synthetic Polynucleotide
caggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagt

SEQ ID NO: 327 - DNA, 360 bp, Artificial Sequence
  Synthetic Polynucleotide
gaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctca

SEQ ID NO: 328 - DNA, 357 bp, Artificial Sequence
  Synthetic Polynucleotide
gtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctca

SEQ ID NO: 329 - DNA, 360 bp, Artificial Sequence
  Synthetic Polynucleotide
caggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagt

SEQ ID NO: 330 - DNA, 363 bp, Artificial Sequence
  Synthetic Polynucleotide
gaagtgcagctcgttgagtctggtggcggactggttcaacctggcggaagcctgagactgtcttgtgccgccagcggcttcaccttcagcagctcttggatgaactgggtccgacaggcccctggcaaaggactggaatgggtcggaagaatctaccccggcgacggcgacaccaactacaacggcaagttcaagggcagattcaccatcagccgggacgacagcaagaacagcctgtacctgcagatgaactccctgaaaaccgaggacaccgccgtgtactactgtgccagatccggcttcatcaccaccgtgctggacttcgattattggggccagggcaccctggtcaccgtttcttct

SEQ ID NO: 331 - DNA, 363 bp, Artificial Sequence
  Synthetic Polynucleotide
gaagtgcaactggttcagagcggagccgaagtgaagaagcctggcgagagcctgaagattagctgcaaaggctccggctacagcttcagcagctcttggatcggctgggtccgacagatgcctggcaaaggactggaatggatgggcatcatctaccccgacgacagcgacaccagatacagccctagcttccagggccaagtgacaatcagcgccgacaagagcatcagaaccgcctacctccagtggtcctctctgaaggccagcgataccgccatgtactactgcgccagacacgtgaccatgatctggggagtgattatcgacttctggggccagggaaccctggtcacagtctcttct

SEQ ID NO: 332 - DNA, 363 bp, Artificial Sequence
  Synthetic Polynucleotide
gaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttct

SEQ ID NO: 333 - DNA, 369 bp, Artificial Sequence
  Synthetic Polynucleotide
caggtgcagctggttgaatctggcggcggacttgttgagcctggcggatctctgagactgagctgcatgagcggctacgccttcagcagctactggatgaactgggtccgacagatgcccggcaaaggactggaatggatgggccagatttggcctggcgacggcgataccaactacaaccccagcctgaagtccagagtgaccatcaccgccgatgagagcaccagcaccgcctacatggaactgtctagcctgaaggccgaggatacagccgtgtacttctgcgccagacgggaaaccacaaccgtgggcagatattactacgctatggactactggggccagggcaccctggttacagtctcttct

SEQ ID NO: 334 - DNA, 360 bp, Artificial Sequence
  Synthetic Polynucleotide
caggtgcaactggttgagtctggcggcggacttgttgaacctggcggaagcctgagactgagctgcatgagcggctacgcctttagcagctcctggatgaactgggtccgacagatgcctggcaaaggactggaatggatgggcagaatctaccccggcgacggcgacaccaactacaacggcaagttcaaagaacgggtcaccatcaccgccgacgagagcacaagcaccgcctacatggaactgagcagcctgaaggccgaggataccgccgtgtacttctgcgccagaagcgagtattggggcaactactgggctatggactactggggccagggcacactggtcacagtgtctagc

SEQ ID NO: 335 - DNA, 363 bp, Artificial Sequence
  Synthetic Polynucleotide
caggtgcaactggttgaatcaggcggaggactggtggaacctggcggatctctgagactgagctgtatgagcggctacgccttcagcagctactggatgaactgggtccgacagatgcccggcaaaggactggaatggatgggccaaatctaccccggcgacggcgacaccaactacaacggcaagttcaagggcagagtgacaatcaccgccgacgagagcacaagcaccgcctacatggaactgagcagcctgaaggccgaggataccgccgtgtacttctgcgccagaaagaccatcagcagcgtggtggatttctacttcgacaactggggccagggcaccctggtcacagtttcttct

SEQ ID NO: 336 - DNA, 360 bp, Artificial Sequence
  Synthetic Polynucleotide
caagttcagctggaacaacctggcgctgaggtggtcaaaccaggggcctctgtgaaggtgtcctgcaagacaagcggctacacattcaccagcaactggatgcactgggtcaagcagacccctggcaaaggactggaatggatcggcgagatcgaccccagcgactcctacaccaactacaaccagaagttcgacggcaaggccaagctgaccgtggacaagtctagcagcaccgcctacatggaagtgtccgatctgaccgccgaagatagcgccacatattactgcgccagaggcagcaacccctactactacgctatggactattggggccagggcaccagcgtgacagtctcttct

SEQ ID NO: 337 - DNA, 363 bp, Artificial Sequence
  Synthetic Polynucleotide
caagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagt

SEQ ID NO: 338 - DNA, 372 bp, Artificial Sequence
  Synthetic Polynucleotide
caggtgcagctgcagcagagcggcgccgaggtgaagaagcccggcagcagcgtgaaggtgagctgcaaggccagcggctacgccttcagcagctactggatgaactgggtgagacagagacccggccagggcctggagtggatcggccagatttggcccggcgacggcgacaccaactacaacggcaagttcaagggcagagccaccatcaccgccgacgagagcaccaacaccgcctacatggagctgagcagcctgagaagcgaggacaccgccttctacagctgcgccagaagagagaccaccaccgtgggcagatactactacgctatggactactggggccagggcaccaccgtgaccgtgagcagc

SEQ ID NO: 339 - DNA, 366 bp, Artificial Sequence
  Synthetic Polynucleotide
gaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatct

SEQ ID NO: 340 - DNA, 357 bp, Artificial Sequence
  Synthetic Polynucleotide
caggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagc

SEQ ID NO: 341 - DNA, 366 bp, Artificial Sequence
  Synthetic Polynucleotide
gaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttct

SEQ ID NO: 342 - DNA, 375 bp, Artificial Sequence
  Synthetic Polynucleotide
gaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttct

SEQ ID NO: 343 - DNA, 369 bp, Artificial Sequence
  Synthetic Polynucleotide
gctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttct

SEQ ID NO: 344 - DNA, 366 bp, Artificial Sequence
  Synthetic Polynucleotide
gaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttct

SEQ ID NO: 345 - DNA, 363 bp, Artificial Sequence
  Synthetic Polynucleotide
caggttcagctccagcagtctggggccgaagtgaagaaacctggcagctccgtgaaagtgtcctgcaaggccagcggctacacctttaccagctacaacatgcactgggtcaagcaggcccctggacagggactcgaatggatcggagccatctatcccggcaacggcgacacctcctacaaccagaagttcaagggcaaagccacactgaccgccgacgagagcacaaacaccgcctacatggaactgagcagcctgagaagcgaggacaccgccttctactactgtgcccggtctacctactacggcggcgactggtactttgacgtgtggggccagggaaccaccgtgacagtttcttct

SEQ ID NO: 346 - DNA, 384 bp, Artificial Sequence
  Synthetic Polynucleotide
cagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaacc

SEQ ID NO: 347 - DNA, 360 bp, Artificial Sequence
  Synthetic Polynucleotide
caggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagc

SEQ ID NO: 348 - DNA, 366 bp, Artificial Sequence; identical to SEQ ID NO: 344
  Synthetic Polynucleotide

SEQ ID NO: 349 - DNA, 366 bp, Artificial Sequence
  Synthetic Polynucleotide
caggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttct

SEQ ID NO: 350 - DNA, 366 bp, Artificial Sequence
  Synthetic Polynucleotide
gaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttct

SEQ ID NO: 351 - DNA, 363 bp, Artificial Sequence
  Synthetic Polynucleotide
gaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttct

SEQ ID NO: 352 - DNA, 360 bp, Artificial Sequence
  Synthetic Polynucleotide
gaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagc

SEQ ID NO: 353 - DNA, 351 bp, Artificial Sequence
  Synthetic Polynucleotide
caggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctct

SEQ ID NO: 354 - DNA, 372 bp, Artificial Sequence
  Synthetic Polynucleotide
caggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagc

SEQ ID NO: 355 - DNA, 351 bp, Artificial Sequence
  Synthetic Polynucleotide
caggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagc

SEQ ID NO: 356 - DNA, 336 bp, Artificial Sequence
  Synthetic Polynucleotide
caggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagc

SEQ ID NO: 357 - DNA, 351 bp, Artificial Sequence
  Synthetic Polynucleotide
caggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctct

SEQ ID NO: 358 - DNA, 357 bp, Artificial Sequence
  Synthetic Polynucleotide
gaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatct

SEQ ID NO: 359 - DNA, 360 bp, Artificial Sequence
  Synthetic Polynucleotide
gaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagt

SEQ ID NO: 360 - DNA, 348 bp, Artificial Sequence
  Synthetic Polynucleotide
gatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgct

SEQ ID NO: 361 - DNA, 354 bp, Artificial Sequence
  Synthetic Polynucleotide
caggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatct

SEQ ID NO: 362 - DNA, 366 bp, Artificial Sequence
  Synthetic Polynucleotide
caggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctct

SEQ ID NO: 363 - DNA, 357 bp, Artificial Sequence
  Synthetic Polynucleotide
caagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctcc

SEQ ID NO: 364 - DNA, 366 bp, Artificial Sequence
  Synthetic Polynucleotide
gaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaaga

SEQ ID NO: 365 - DNA, 351 bp, Artificial Sequence
  Synthetic Polynucleotide
caggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagt

SEQ ID NO: 366 - DNA, 351 bp, Artificial Sequence
  Synthetic Polynucleotide
caagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctct

SEQ ID NO: 367 - DNA, 351 bp, Artificial Sequence
  Synthetic Polynucleotide
gaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagc

SEQ ID NO: 368 - DNA, 351 bp, Artificial Sequence
  Synthetic Polynucleotide
gaggttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagc

SEQ ID NO: 369 - DNA, 354 bp, Artificial Sequence
  Synthetic Polynucleotide
gaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttct

SEQ ID NO: 370 - DNA, 366 bp, Artificial Sequence
  Synthetic Polynucleotide
cagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctct

SEQ ID NO: 371 - DNA, 342 bp, Artificial Sequence
  Synthetic Polynucleotide
gaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctct

SEQ ID NO: 372 - DNA, 363 bp, Artificial Sequence
  Synthetic Polynucleotide
caggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagc

SEQ ID NO: 373 - DNA, 363 bp, Artificial Sequence; identical to SEQ ID NO: 372
  Synthetic Polynucleotide

SEQ ID NO: 374 - DNA, 354 bp, Artificial Sequence
  Synthetic Polynucleotide
caggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctct

SEQ ID NO: 375 - DNA, 339 bp, Artificial Sequence
  Synthetic Polynucleotide
caggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagc

SEQ ID NO: 376 - DNA, 351 bp, Artificial Sequence
  Synthetic Polynucleotide
gaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttca

SEQ ID NO: 377 - DNA, 342 bp, Artificial Sequence
  Synthetic Polynucleotide
caagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagt

SEQ ID NO: 378 - DNA, 369 bp, Artificial Sequence
  Synthetic Polynucleotide
gaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagt

SEQ ID NO: 379 - DNA, 375 bp, Artificial Sequence
  Synthetic Polynucleotide
caggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatct

SEQ ID NO: 380 - DNA, 348 bp, Artificial Sequence
  Synthetic Polynucleotide
caggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctct

SEQ ID NO: 381 - DNA, 354 bp, Artificial Sequence
  Synthetic Polynucleotide
caggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatct

SEQ ID NO: 382 - DNA, 354 bp, Artificial Sequence
  Synthetic Polynucleotide
caggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctct

SEQ ID NO: 383 - DNA, 345 bp, Artificial Sequence
  Synthetic Polynucleotide
gaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatct

SEQ ID NO: 384 - DNA, 360 bp, Artificial Sequence
  Synthetic Polynucleotide
gaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctct

SEQ ID NO: 385 - DNA, 360 bp, Artificial Sequence
  Synthetic Polynucleotide
gaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctct

SEQ ID NO: 386 - DNA, 363 bp, Artificial Sequence
  Synthetic Polynucleotide
gaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagt

SEQ ID NO: 387 - DNA, 366 bp, Artificial Sequence
  Synthetic Polynucleotide
gaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatct

SEQ ID NO: 388 - DNA, 369 bp, Artificial Sequence
  Synthetic Polynucleotide
caagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttct

SEQ ID NO: 389 - DNA, 369 bp, Artificial Sequence
  Synthetic Polynucleotide
gaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttct

SEQ ID NO: 390 - DNA, 366 bp, Artificial Sequence
  Synthetic Polynucleotide
caggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagc

SEQ ID NO: 391 - DNA, 366 bp, Artificial Sequence
  Synthetic Polynucleotide
cagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctca

SEQ ID NO: 392 - DNA, 357 bp, Artificial Sequence
  Synthetic Polynucleotide
gaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatct

SEQ ID NO: 393 - DNA, 360 bp, Artificial Sequence
  Synthetic Polynucleotide
caggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagc

SEQ ID NO: 394 - DNA, 360 bp, Artificial Sequence
  Synthetic Polynucleotide
caagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatct

SEQ ID NO: 395 - DNA, 351 bp, Artificial Sequence
  Synthetic Polynucleotide
gaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttct

SEQ ID NO: 396 - DNA, 351 bp, Artificial Sequence
  Synthetic Polynucleotide
gaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttct

SEQ ID NO: 397 - DNA, 351 bp, Artificial Sequence
  Synthetic Polynucleotide
gaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttct

SEQ ID NO: 398 - DNA, 363 bp, Artificial Sequence
  Synthetic Polynucleotide
caggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgct

SEQ ID NO: 399 - DNA, 360 bp, Artificial Sequence
  Synthetic Polynucleotide
caggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatct

SEQ ID NO: 400 - DNA, 360 bp, Artificial Sequence
  Synthetic Polynucleotide
caggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagc

SEQ ID NO: 401 - DNA, 360 bp, Artificial Sequence
  Synthetic Polynucleotide
caggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagc

SEQ ID NO: 402 - DNA, 372 bp, Artificial Sequence
  Synthetic Polynucleotide
cagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagt

SEQ ID NO: 403 - DNA, 354 bp, Artificial Sequence
  Synthetic Polynucleotide
caggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctct

SEQ ID NO: 404 - DNA, 345 bp, Artificial Sequence
  Synthetic Polynucleotide
gaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtcc

SEQ ID NO: 405 - DNA, 357 bp, Artificial Sequence
  Synthetic Polynucleotide
caggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgct

SEQ ID NO: 406 - DNA, 369 bp, Artificial Sequence
  Synthetic Polynucleotide
caggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagt

SEQ ID NO: 407 - DNA, 348 bp, Artificial Sequence
  Synthetic Polynucleotide
gaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctct

SEQ ID NO: 408 - DNA, 342 bp, Artificial Sequence
  Synthetic Polynucleotide
gagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagc

SEQ ID NO: 409 - DNA, 381 bp, Artificial Sequence
  Synthetic Polynucleotide
gaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatct

SEQ ID NO: 410 - DNA, 360 bp, Artificial Sequence
  Synthetic Polynucleotide
gaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagt

SEQ ID NO: 411 - DNA, 351 bp, Artificial Sequence
  Synthetic Polynucleotide
gaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtct

SEQ ID NO: 412 - DNA, 354 bp, Artificial Sequence
  Synthetic Polynucleotide
ggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctaca

SEQ ID NO: 413 - DNA, 378 bp, Artificial Sequence
  Synthetic Polynucleotide
caggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttct

SEQ ID NO: 414 - DNA, 372 bp, Artificial Sequence
  Synthetic Polynucleotide
gtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagt

SEQ ID NO: 415 - DNA, 366 bp, Artificial Sequence
  Synthetic Polynucleotide
agggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgct

SEQ ID NO: 416 - DNA, 354 bp, Artificial Sequence
  Synthetic Polynucleotide
caggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagt

SEQ ID NO: 417 - DNA, 372 bp, Artificial Sequence
  Synthetic Polynucleotide
caggtgcaactggtgcagagcggagccgaagtgaagaaacctggggccagcgtgaaggtgtcctgcaaggccagcggctacacctttaccacctacggcatctcttgggtgcgccaggctcctggacagggactggaatggatgggctggatcagcgcctacaacggccacaccaactacgcccagatgctccagggcagagtgaccatgaccaccgacaccagcacctccaccgcctacatggaactgcggggcctgagaagcgacgacaccgccgtgtattattgcgccagagaagcctacgcctcctacggcagcggcagctactggaccgattattggggccagggcaccctcgtgaccgtgtctagt

SEQ ID NO: 418 - DNA, 339 bp, Artificial Sequence
  Synthetic Polynucleotide
gaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagt

SEQ ID NO: 419 - DNA, 363 bp, Artificial Sequence
  Synthetic Polynucleotide
caggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgt

SEQ ID NO: 420 - DNA, 357 bp, Artificial Sequence
  Synthetic Polynucleotide
gaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatct

SEQ ID NO: 421 - DNA, 369 bp, Artificial Sequence
  Synthetic Polynucleotide
cagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagc

SEQ ID NO: 422 - DNA, 354 bp, Artificial Sequence
  Synthetic Polynucleotide
gagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatct

SEQ ID NO: 423 - DNA, 363 bp, Artificial Sequence
  Synthetic Polynucleotide
gaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatct

SEQ ID NO: 424 - DNA, 366 bp, Artificial Sequence
  Synthetic Polynucleotide
gaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagc

SEQ ID NO: 425 - DNA, 372 bp, Artificial Sequence
  Synthetic Polynucleotide
gaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctct

SEQ ID NO: 426 - DNA, 357 bp, Artificial Sequence
  Synthetic Polynucleotide
caagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatct

SEQ ID NO: 427 - DNA, 345 bp, Artificial Sequence
  Synthetic Polynucleotide
caggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgct

SEQ ID NO: 428 - DNA, 357 bp, Artificial Sequence
  Synthetic Polynucleotide
caggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagt

SEQ ID NO: 429 - DNA, 348 bp, Artificial Sequence
  Synthetic Polynucleotide
gaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtg

SEQ ID NO: 430 - DNA, 351 bp, Artificial Sequence
  Synthetic Polynucleotide
gaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttct

SEQ ID NO: 431 - DNA, 342 bp, Artificial Sequence
  Synthetic Polynucleotide
gaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttct

SEQ ID NO: 432 - DNA, 354 bp, Artificial Sequence
  Synthetic Polynucleotide
gaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatct

SEQ ID NO: 433 - DNA, 360 bp, Artificial Sequence
  Synthetic Polynucleotide
gaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatct

SEQ ID NO: 434 - DNA, 387 bp, Artificial Sequence
  Synthetic Polynucleotide
caggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggaccc

SEQ ID NO: 435 - DNA, 354 bp, Artificial Sequence
  Synthetic Polynucleotide
gaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctct

SEQ ID NO: 436 - DNA, 405 bp, Artificial Sequence
  Synthetic Polynucleotide
cagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagc

SEQ ID NO: 437 - DNA, 363 bp, Artificial Sequence
  Synthetic Polynucleotide
caggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagc

SEQ ID NO: 438 - DNA, 384 bp, Artificial Sequence
  Synthetic Polynucleotide
ctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctca

SEQ ID NO: 439 - DNA, 369 bp, Artificial Sequence
  Synthetic Polynucleotide
caagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttct

SEQ ID NO: 440 - DNA, 366 bp, Artificial Sequence
  Synthetic Polynucleotide
gaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagc

SEQ ID NO: 441 - DNA, 366 bp, Artificial Sequence
  Synthetic Polynucleotide
cttgaaatggcccaggttcagctccagcagtggggagctggactgctgaagcctagcgagacactgagcctgacctgtgctgtgtacggcggcagcttcagcggctactactggtcctggatcagacagcctcctggcaaaggactggaatggatcggcgagatcaaccacagcggctccaccaactacaaccccagcctgaagtccagagtgaccatcagcgtggacaccagcaagaaccagttctccctgaagctgagcagcgtgacagccgctgataccgccgtgtactattgcgctagagcccctcagtcttggtacgtgggagatgtgtggggccagggcacactggttacagtgtcatct

SEQ ID NO: 442 - DNA, 366 bp, Artificial Sequence
  Synthetic Polynucleotide
caagttcaactggttcagagcggagccgaagtgaagaaacctggcagcagcgtgaaggtgtcctgcaaagcaagcggcggcacctttagcagctacgccatctcttgggtccgacaggcacctggacaaggactggaatggatgggcggcatcatccccatcttcggcacagccaattacgcccagaaattccagggcagagtgaccatcaccgccgacgagtctacaagcaccgcctacatggaactgagcagcctgagaagcgaggacaccgccgtgtactattgtgccagaggcgtgtacggctacagcggctctgccccttatgatgagtggggccagggaaccctggtcaccgtttcttct

SEQ ID NO: 443 - DNA, 366 bp, Artificial Sequence
  Synthetic Polynucleotide
gaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctct

SEQ ID NO: 444 - DNA, 372 bp, Artificial Sequence
  Synthetic Polynucleotide
caggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatct

SEQ ID NO: 445 - DNA, 354 bp, Artificial Sequence
  Synthetic Polynucleotide
gaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagc

SEQ ID NO: 446 - DNA, 348 bp, Artificial Sequence
  Synthetic Polynucleotide
gaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctct

SEQ ID NO: 447 - DNA, 366 bp, Artificial Sequence
  Synthetic Polynucleotide
gaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatct

SEQ ID NO: 448 - DNA, 321 bp, Artificial Sequence
  Synthetic Polynucleotide
gacattcaaatgacgcagagcccctcctctctgtcagcgagcgtgggagatagtgtcacgattacttgtcaggccagccaagacatttcctcatatctgaactggtatcagcagaagcccggcaaggcccccgaactgttgatctactacggcagcgagttggaatccggcgttccttctcgcttttccgggtccggctctggaacagatttcaccttcaccatttctagccttgaagcagaagacgccgccacttactactgcgggcaaggtaaccgattgccgtacaccttcggccagggtacaaaagtggaaatcgag

SEQ ID NO: 449 - DNA, 384 bp, Artificial Sequence
  Synthetic Polynucleotide
caagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagt

SEQ ID NO: 450 - DNA, 363 bp, Artificial Sequence
  Synthetic Polynucleotide
gaggttcagctccagcagtctgggactgtgctggcaaggcctgggacttccgtgaagatgtcctgcagggcttctggctacagctttaccaccttctggatgcactgggtaaaacagaggcctggacagggtccagaatggattggtgctatttatcctgaaaatagtgatactaggtacaacccgactttcaaggacaaggccgaactgactgcagtcacatccgccaacactgtctacatggaactcagcagcctgacagatgaggactctgcggtctattactgtacaagaccgtccctctatgctatggactactggggtcaaggaacctcagtcaccgtctcctcagccaaaacaaca

SEQ ID NO: 451 - DNA, 366 bp, Artificial Sequence
  Synthetic Polynucleotide
cagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctct

SEQ ID NO: 452 - DNA, 351 bp, Artificial Sequence
  Synthetic Polynucleotide
gaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctct

SEQ ID NO: 453 - DNA, 354 bp, Artificial Sequence
  Synthetic Polynucleotide
caggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctct

SEQ ID NO: 454 - DNA, 357 bp, Artificial Sequence
  Synthetic Polynucleotide
caggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatct

SEQ ID NO: 455 - DNA, 354 bp, Artificial Sequence
  Synthetic Polynucleotide
gaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagt

SEQ ID NO: 456 - DNA, 357 bp, Artificial Sequence
  Synthetic Polynucleotide
caggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagcc

SEQ ID NO: 457 - DNA, 381 bp, Artificial Sequence
  Synthetic Polynucleotide
gaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctca

SEQ ID NO: 458 - DNA, 360 bp, Artificial Sequence
  Synthetic Polynucleotide
gaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagt

SEQ ID NO: 459 - DNA, 354 bp, Artificial Sequence
  Synthetic Polynucleotide
caactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagt

SEQ ID NO: 460 - DNA, 357 bp, Artificial Sequence
  Synthetic Polynucleotide
caggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgatatctggggccagggcacaatggtcaccgtgtcctct

SEQ ID NO: 461 - DNA, 357 bp, Artificial Sequence
  Synthetic Polynucleotide
caggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctct

SEQ ID NO: 462 - DNA, 354 bp, Artificial Sequence
  Synthetic Polynucleotide
gatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctct

SEQ ID NO: 463 - DNA, 354 bp, Artificial Sequence
  Synthetic Polynucleotide
gatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagc

SEQ ID NO: 464 - DNA, 354 bp, Artificial Sequence
  Synthetic Polynucleotide
gacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagc

SEQ ID NO: 465 - DNA, 360 bp, Artificial Sequence
  Synthetic Polynucleotide
gaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctct

SEQ ID NO: 466 - DNA, 345 bp, Artificial Sequence
  Synthetic Polynucleotide
caggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgca

SEQ ID NO: 467 - DNA, 354 bp, Artificial Sequence
  Synthetic Polynucleotide
caggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatct

SEQ ID NO: 468 - DNA, 339 bp, Artificial Sequence
  Synthetic Polynucleotide
caggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagc

SEQ ID NO: 469 - DNA, 345 bp, Artificial Sequence
  Synthetic Polynucleotide
gaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagt

SEQ ID NO: 470 - DNA, 369 bp, Artificial Sequence
  Synthetic Polynucleotide
gaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagc

SEQ ID NO: 471 - DNA, 363 bp, Artificial Sequence
  Synthetic Polynucleotide
gaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatct

SEQ ID NO: 472 - DNA, 366 bp, Artificial Sequence
  Synthetic Polynucleotide
gtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagt

SEQ ID NO: 473 - DNA, 345 bp, Artificial Sequence
  Synthetic Polynucleotide
caagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagc

SEQ ID NO: 474 - DNA, 342 bp, Artificial Sequence
  Synthetic Polynucleotide
gtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctct

SEQ ID NO: 475 - DNA, 354 bp, Artificial Sequence
  Synthetic Polynucleotide
gtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatct

SEQ ID NO: 476 - DNA, 357 bp, Artificial Sequence
  Synthetic Polynucleotide
gaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatct

SEQ ID NO: 477 - DNA, 339 bp, Artificial Sequence
  Synthetic Polynucleotide
caggtgtacctggtggaaagcggagggggcgtggtgcagcctggaagaagcctgagactgagctgtgccgccagcggcttcaccttcagcaactacggaatgcactgggtgcgccaggcccctggcaaaggactggaatgggtggccctgatttggtacgacggcagcaacaagtattacgccgacagcgtgaagggccggttcaccatcagccgggacaacagcaagaacaccctgtacctccagatgaccagcctgcgggtggaagataccgccgtgtattattgcgccagcaacgtggaccactggggccagggaacactcgtgaccgtgtctagc

SEQ ID NO: 478 - DNA, 330 bp, Artificial Sequence
  Synthetic Polynucleotide
caggtgcagctggtggaaagtgggggaggatggcagcctggcagaagcctgagactggactgcaaggccagcggcatcaccttcagcaacagcggaatgcactgggtgcgccaggcccctggaaagggactggaatgggtggccgtgatctatgacggcagcaagcggtactacgccgacagcgtgaagggccggttcatcagccgggacaacagcaagaataccctgttcctccagatgaacagcctgcgggccgaggacacagccgtgtattattgcgccaccaacgacgactactggggccagggaacactcgtgaccgtgtcctct

SEQ ID NO: 479 - DNA, 354 bp, Artificial Sequence
  Synthetic Polynucleotide
gaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatct

SEQ ID NO: 480 - DNA, 345 bp, Artificial Sequence
  Synthetic Polynucleotide
caatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagt

SEQ ID NO: 481 - DNA, 321 bp, Artificial Sequence
  Synthetic Polynucleotide
gaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttct

SEQ ID NO: 482 - DNA, 402 bp, Artificial Sequence
  Synthetic Polynucleotide
gtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatct

SEQ ID NO: 483 - DNA, 390 bp, Artificial Sequence
  Synthetic Polynucleotide
ggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagt

SEQ ID NO: 484 - DNA, 369 bp, Artificial Sequence
  Synthetic Polynucleotide
caggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatct

SEQ ID NO: 485 - DNA, 345 bp, Artificial Sequence
  Synthetic Polynucleotide
gaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagt

SEQ ID NO: 486 - DNA, 360 bp, Artificial Sequence
  Synthetic Polynucleotide
cagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatct

SEQ ID NO: 487 - DNA, 345 bp, Artificial Sequence
  Synthetic Polynucleotide
caggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgct

SEQ ID NO: 488 - DNA, 357 bp, Artificial Sequence
  Synthetic Polynucleotide
gaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatct

SEQ ID NO: 489 - DNA, 360 bp, Artificial Sequence
  Synthetic Polynucleotide
gaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagt

SEQ ID NO: 490 - DNA, 369 bp, Artificial Sequence
  Synthetic Polynucleotide
caggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagt

SEQ ID NO: 491 - DNA, 378 bp, Artificial Sequence
  Synthetic Polynucleotide
caggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagt

SEQ ID NO: 492 - DNA, 357 bp, Artificial Sequence
  Synthetic Polynucleotide
caggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttct

SEQ ID NO: 493 - DNA, 360 bp, Artificial Sequence
  Synthetic Polynucleotide
caggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatct

SEQ ID NO: 494 - DNA, 372 bp, Artificial Sequence
  Synthetic Polynucleotide
gaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctct

SEQ ID NO: 495 - DNA, 357 bp, Artificial Sequence
  Synthetic Polynucleotide
caggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctct

SEQ ID NO: 496 - DNA, 354 bp, Artificial Sequence
  Synthetic Polynucleotide
gaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctct

SEQ ID NO: 497 - DNA, 357 bp, Artificial Sequence
  Synthetic Polynucleotide
gaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgct

SEQ ID NO: 498 - DNA, 369 bp, Artificial Sequence
  Synthetic Polynucleotide
caggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctcc

SEQ ID NO: 499 - DNA, 357 bp, Artificial Sequence
  Synthetic Polynucleotide
caggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctct

SEQ ID NO: 500 - DNA, 354 bp, Artificial Sequence
  Synthetic Polynucleotide
caagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctct

SEQ ID NO: 501 - DNA, 363 bp, Artificial Sequence
  Synthetic Polynucleotide
caactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctct

SEQ ID NO: 502 - DNA, 369 bp, Artificial Sequence
  Synthetic Polynucleotide
caggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctct

SEQ ID NO: 503 - DNA, 360 bp, Artificial Sequence
  Synthetic Polynucleotide
caggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatct

SEQ ID NO: 504 - DNA, 348 bp, Artificial Sequence
  Synthetic Polynucleotide
caggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagt

SEQ ID NO: 505 - DNA, 348 bp, Artificial Sequence
  Synthetic Polynucleotide
caggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagc

SEQ ID NO: 506 - DNA, 363 bp, Artificial Sequence
  Synthetic Polynucleotide
cagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatct

SEQ ID NO: 507 - DNA, 357 bp, Artificial Sequence
  Synthetic Polynucleotide
caggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctct

SEQ ID NO: 508 - DNA, 378 bp, Artificial Sequence
  Synthetic Polynucleotide
gaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagt

SEQ ID NO: 509 - DNA, 357 bp, Artificial Sequence
  Synthetic Polynucleotide
caggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctct

SEQ ID NO: 510 - DNA, 351 bp, Artificial Sequence
  Synthetic Polynucleotide
gaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctct

SEQ ID NO: 511 - DNA, 366 bp, Artificial Sequence
  Synthetic Polynucleotide
caggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagc

SEQ ID NO: 512 - DNA, 363 bp, Artificial Sequence
  Synthetic Polynucleotide
gaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagt

SEQ ID NO: 513 - DNA, 357 bp, Artificial Sequence
  Synthetic Polynucleotide
caactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagt

SEQ ID NO: 514 - DNA, 369 bp, Artificial Sequence
  Synthetic Polynucleotide
gaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagt

SEQ ID NO: 515 - DNA, 369 bp, Artificial Sequence
  Synthetic Polynucleotide
caggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagt

SEQ ID NO: 516 - DNA, 363 bp, Artificial Sequence
  Synthetic Polynucleotide
cagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagc

SEQ ID NO: 517 - DNA, 354 bp, Artificial Sequence
  Synthetic Polynucleotide
caggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagt

SEQ ID NO: 518 - DNA, 357 bp, Artificial Sequence
  Synthetic Polynucleotide
caggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatct

SEQ ID NO: 519 - DNA, 363 bp, Artificial Sequence
  Synthetic Polynucleotide
gaagtgcaactggtgcagtctggcggaggggtcatgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgttaccgtgtcctct

SEQ ID NO: 520 - DNA, 363 bp, Artificial Sequence
  Synthetic Polynucleotide
gaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctct

SEQ ID NO: 521 - DNA, 360 bp, Artificial Sequence
  Synthetic Polynucleotide
gacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagc

SEQ ID NO: 522 - DNA, 357 bp, Artificial Sequence
  Synthetic Polynucleotide
caggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagt

SEQ ID NO: 523 - DNA, 354 bp, Artificial Sequence
  Synthetic Polynucleotide
gaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctct

SEQ ID NO: 524 - DNA, 363 bp, Artificial Sequence
  Synthetic Polynucleotide
caagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttct

SEQ ID NO: 525 - DNA, 339 bp, Artificial Sequence
  Synthetic Polynucleotide
gaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatct

SEQ ID NO: 526 - DNA, 348 bp, Artificial Sequence
  Synthetic Polynucleotide
gaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatct

SEQ ID NO: 527 - DNA, 363 bp, Artificial Sequence
  Synthetic Polynucleotide
gaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttct

SEQ ID NO: 528 - DNA, 363 bp, Artificial Sequence
  Synthetic Polynucleotide
gaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttct

SEQ ID NO: 529 - DNA, 354 bp, Artificial Sequence
  Synthetic Polynucleotide
gaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatct

SEQ ID NO: 530 - DNA, 357 bp, Artificial Sequence
  Synthetic Polynucleotide
caagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttct

SEQ ID NO: 531 - DNA, 360 bp, Artificial Sequence
  Synthetic Polynucleotide
gaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctct

SEQ ID NO: 532 - DNA, 372 bp, Artificial Sequence
  Synthetic Polynucleotide
caggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagt

SEQ ID NO: 533 - DNA, 348 bp, Artificial Sequence
  Synthetic Polynucleotide
caggttcagctccagcagtctgatgccgagctggtcaagcctggcagcagcgtgaagattagctgcaaggccagcggctacaccttcaccgatcacgccatccactgggtcaagcagaagcctgagcagggcctcgaatggatcggccactttagccctggcaacaccgacatcaagtacaacgacaagttcaagggcaaagccacactgaccgtggacagaagcagcagcacagcctacatgcagctgaacagcctgaccagcgaggacagcgccgtgtacttctgcaagaccagcaccttctttttcgactactggggccagggcacaaccctgacagtttcttct

SEQ ID NO: 534 - DNA, 342 bp, Artificial Sequence
  Synthetic Polynucleotide
caagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttct

SEQ ID NO: 535 - DNA, 378 bp, Artificial Sequence
  Synthetic Polynucleotide
caggtgcagcttgttgaaagcggaggcggagttgtgcagcctggcagaagtctgagactgtcttgtgccgccagcggcttcaccttcagcagctatggaatgcactgggtccgacaggcccctggcaaaggacttgaatgggttgccgtgatctgggacgacggcagcaacaagtattacgtggacagcgtgaagggcagattcaccatcagccgggacaacagcaagaacaccctgtacctccagatgaacagcctgagagccgaggacacagccgtgtattattgcgccagagatgactactacggcagcggctccttcaacagctactatggcacagacgtgtggggccagggcacaacagttaccgttagctct

SEQ ID NO: 536 - DNA, 336 bp, Artificial Sequence
  Synthetic Polynucleotide
gaagtgcaactggttcaatctggcggcggactggttcatccaggcggttctctgagactgagctgtgccggctctggcttcaccttcagcacctacctgatgtactgggtccgacaggcccctggcaagacactggaatgggtgtccgctattggcagcggaggcgatacctactacgccgactctgtgaagggcagattcaccatcagccgggacaacgccaagaacagcctgtacctccagatgaactccctgagagccgaggacatggccgtgtactactgtgccagaggactcggctattggggccagggaacactggtcacagtgtcctct

SEQ ID NO: 537 - DNA, 390 bp, Artificial Sequence
  Synthetic Polynucleotide
gaagttcaactggtgcagagcggagccgaagtgaagaagccaggcgagagcctgaagattagctgcaaaggcagcggctacagcttcaccagctactggatcggctgggtccgacagatgcctggcaaaggactggaatggatgggcatcatctaccccggcgacagcgacaccagatacagccctagctttcagggccaagtgaccatctccgccgacaagagcatcagcacagcctacctccagtggtcctctctgaaggccagcgataccgccatgtactactgcgccagacaagtctggggatggcaaggcggcatgtaccccaggtctaactggtggtacaacctggactcttggggccagggcacactggtcacagtctcttct

SEQ ID NO: 538 - DNA, 351 bp, Artificial Sequence
  Synthetic Polynucleotide
caagttcagctggttcagagcggagccgaagtgaagaaacctggcagcagcgtgaaggtgtcctgcaaagcaagcggcggcaccttcagcagctacaccatcaacgtttggagacaggccccaggccagggccttgaatggatgggaggcttcatccctatcagcggcaccgtgaactacgcccagaaattccagggcagagtgacaatcaccgccgacgagagcacaagcaccgcctacatggaactgtccagcctgagaagcgaggacaccgccgtgtactactgtgccagacctctggattggaccgaggacatctggggccagggaacactggtcacagtgtctagt

SEQ ID NO: 539 - DNA, 357 bp, Artificial Sequence
  Synthetic Polynucleotide
gaagttcagctggttcagagcggagccgaagtgaagaaacctggggcctctgtgaaggtgtcctgcaaggcttccggctacacctttaccgcctactacctgcactggctgagacaggctccaggccaaggactggaatggatgggctggatgaacaccaacaacggggccaccagatacgcccagaaattccaggacagagtgaccatgaccagagacaccagcatcaacaccgcctacatggaaatgagcggcctgtcctccgacgacaccgccatgtactattgtgccagaggcgacatcagccaggacttcgctgatgtgtggggccagggaacactggtcacagtgtcatct

SEQ ID NO: 540 - DNA, 351 bp, Artificial Sequence
  Synthetic Polynucleotide
caggttcagctccagcagagcggagccgagcttatgaagcctggcgcttccgtgaagatcagctgcaaggccaccggctacaccttcagcagctactggatcgagtgggtcaagcagaggcccggacatggcctggaatggatcggagagatcctgcctggaagcggcagcaccaactacaacgagaagttcaagggcaaagccaccttcaccgccgacaccagcagcaacacagcctatatgcagctgagcagcctgaccagcgaggacagcgccgtgtactactgcgccagatacgactacccttggtttgcctattggggccagggcaccctggttacagtttctgct

SEQ ID NO: 541 - DNA, 354 bp, Artificial Sequence
  Synthetic Polynucleotide
caagttcagctgcaacagcctggggccgaactcgttagacctggcgcttctgtgaagctgtcctgcaaggccagcggctacacctttaccagctactggatcaactgggtcaagcagcggcctggacagggcctcgaatggatcggcaatatctaccccagcgacagctacaccaactacaatcagaagttcaaggacaaggccacactgaccgtggacaagtctagcagcaccgcctacatgcagctgagcagccctacaagcgaggacagcgccgtgtattattgcacccggtcttggcggggcaacagcttcgattattggggccagggcacaaccctgaccgtgtcatct

SEQ ID NO: 542 - DNA, 366 bp, Artificial Sequence
  Synthetic Polynucleotide
caagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagt

SEQ ID NO: 543 - DNA, 363 bp, Artificial Sequence
  Synthetic Polynucleotide
gaagttcagctccagcagagcggccctgaccttgtgaaacctggcgcttccgtgaagatgagctgcaaggccagcggctacaccttcaccagctacgtgatgcactgggtcaagcagaaacccggccagggccttgagtggatcggctacatctacccctacaacgatggcaccaagtacaacgagaagttcaagggcaaagccacactgaccagcgacaagtctagcagcaccgcctacatggaactgagcagcctgacctctgaggacagcgccgtgtactactgcgccagagaggaatacggcaactacgtgcggtacttcgacgtgtggggagccggaacaaccgtgacagtctcttct

SEQ ID NO: 544 - DNA, 351 bp, Artificial Sequence
  Synthetic Polynucleotide
caagttcagctggttcagtctggggccgaagtgaagaaacctggcagcagcgtgaaggtgtcctgcaaggcttccggcgataccttcagcagctactacatcagctgggtccgacaggccccaggacaaggacttgagtggatgggcagaatcatccccatcctgggaatcgccaactacgcccagaaataccagggcagagtgaccctgagcgccgacaagagcacaagcaccagctacatggaactgaacagcctgagcagcgaggacaccgccgtgtactattgtgccctggactggtcctacagcatcgactattggggccagggcaccctggtcacagtctcttct

SEQ ID NO: 545 - DNA, 360 bp, Artificial Sequence
  Synthetic Polynucleotide
gaagtgaagctggtggaatctggcggcggactggttaagtttggcggcagcctgaagctgagctgtgccgcctctggctttaccctgagcagctactacatgagctgggtccgacagagccccgagaagagactggaactggtggccgtgattaacagcaacggcggcagcacctactatcccgacacagtgaagggcagattcaccatcagccgggacaacgccaagaacaccctgtacctccagatgtctagcctgaagtccgaggacacagccctgtactactgcgccagaccattctactacagcaacagccccttcgcctattggggccagggaacactggttacagtgtctgct

SEQ ID NO: 546 - DNA, 360 bp, Artificial Sequence
  Synthetic Polynucleotide
gaagtgcagctcgaacagtctggccccgagcttgtgaaacctggcgcttccgtgaagatgagctgcaaggccagcggctacaccttcaccaactactacatgaaatgggtcaagcagagccacggcaagtccctggaatggatcggcgatctgaaccccaacaacggcgacaccttctacaaccagaagttcaagggcaaagccacactgaccgtggacaagagcagcaacaccgcctacatgcagctcaactccctgaccagcgaggacagcgccgtgtactactgtgccagaaccggcagatacgaagagaacgctatggactactggggccagggcacaagcgtgacagtctcttct

SEQ ID NO: 547 - DNA, 351 bp, Artificial Sequence
  Synthetic Polynucleotide
caggttcagctggtgcagtctggcagcgagctgaagaaacctggcgagagcgtgaagatcagctgcaaggccagcggctacaccttcacacactacagcatgaactgggtccgacaggcccctggacaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtactactgctccaacgactacctgtactccctggactattggggccagggcacactggtcacagtgtctagt

SEQ ID NO: 548 - DNA, 351 bp, Artificial Sequence
  Synthetic Polynucleotide
caggtgcagctcgttcagagtggccccgaagtgaaaaagccaggcgagtccgtgaagatttcctgcaaagcctccggctacacattccggcactactctatgaattgggtcaagcaggccccaggccagggccttaagtggatgggacgcatcaataccgagtccggcgtgccaatctacgccgatgacttcaaaggccggttcagcttcaccgtggatacctctgcctccaccgcctacctggaaatcagcagcctgaccagcgaggatacagctgtgtacttctgtagcaacgattacctctacagcctggatttctggggacagggaaccacactgaccgtgtctagc

SEQ ID NO: 549 - DNA, 354 bp, Artificial Sequence
  Synthetic Polynucleotide
caggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttct

SEQ ID NO: 550 - DNA, 357 bp, Artificial Sequence
  Synthetic Polynucleotide
gaagtgatcctggtggaaagcggaggcggccttgtgaaacctggcggatctctgaagctgagctgtgccgccagcggcttcacctttagcagctacacaatgagctgggtccgacagacccctgagaagagactggaatgggtcgccaccatctcttccggcggagggaacacctactatcccgactctgtgaagggcagattcaccatcagccgggacaacgccaagaacaacctgtacctccagatgagcagcctgcggagcgaagatacagccctgtactattgcgcccggtactacagatacgaggcttggtttgcctcttggggccagggcacactggttacagtttctgct

SEQ ID NO: 551 - DNA, 372 bp, Artificial Sequence
  Synthetic Polynucleotide
gaggtgcaactggttgagtctggcggaggactggtgcagcctggaagaagcctgagactgtcttgtgccgccagcggcttcaccttcgacgattatgccatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactactgcgccaaagacaaaggcggaggctactacgacttttggagcggcagcgattattggggccagggcacactggtcacagtgtctagc

SEQ ID NO: 552 - DNA, 381 bp, Artificial Sequence
  Synthetic Polynucleotide
gaagtgcagctccagcagtctggacctggcctggttaagcctagccagacactgagcctgacctgtgccatcagcggcgatagcgtgctgagcaacagcgacacctggaactggatcagacagagccctagcagaggactggaatggctgggcagaacctaccacagaagcacttggtacgacgactacgccagctctgtgcggggcagagtgtccatcaatgtggacaccagcaagaaccagtacagcctgcaactgaacgccgtgacacctgaggataccggcgtgtactactgcgccagagacagactccaggacggcaactcttggagcgacgcctttgatgtgtggggccagggcacaatggtcaccgtttctagc

SEQ ID NO: 553 - DNA, 366 bp, Artificial Sequence
  Synthetic Polynucleotide
caggtgcaactggttcagtctggggccgaagtgaagaaacctggggcctctgtgaaggtgtcctgcaaggcttccggctacacctttaccagctacgacatcaactgggtccgacaggccacaggccaaggactggaatggatgggctggatgaaccccaacagcggcaataccggctacgcccagaaattccagggcagagtgaccatgaccagaaacaccagcatcagcaccgcctacatggaactgagcagcctgagaagcgaggacaccgccgtgtactattgcgccagaggcgacagcaactactggtcctactacggcatggacgtgtggggccagggaacactggttacagtttctagc

SEQ ID NO: 554 - DNA, 381 bp, Artificial Sequence
  Synthetic Polynucleotide
gaagtgcagctccagcagtctggacctggcctggttaagcctagccagacactgagcctgacctgtgccatcagcggcgatagcgtgtcctctaatagcgccgcctggaactggatcagacagagccctagcagaggactggaatggctgggcagaacctactaccgcagcaagtggtacagcgactacgccgtgtccgtgaagtcccggatcaccatcaatcccgacaccagcaagaaccagttcagcctgcaactgaacagcgtgacccctgaggataccgccgtgtactactgcgccagagatccctacgacttttggagcggctaccccgacgcctttgacatctggggacagggcacaatggtcaccgtttctagc

SEQ ID NO: 555 - DNA, 333 bp, Artificial Sequence
  Synthetic Polynucleotide
caatctgctctgacacagcctgccagcgcctctggatctcctggacagagcgtgaccatctcctgtaccggcacctcttctgatgtcggcggctacaactacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactgtacgtgttcggcacaggcacccagctcacagttctt

SEQ ID NO: 556 - DNA, 360 bp, Artificial Sequence
  Synthetic Polynucleotide
caagttcagctgcaagagtctggccctggcctggtcaagcctagccaaacactgagcctgacctgtaccgtcagcggagtgtccctgcctgattatggcgtgtcctggatcagacagcctcctggcaaaggactggaatggatcggcgtgatctggggcagcgagacaacctactacaacagcgccctgaagtccagagtgctgatctccgtggacaccagcaagaaccaggtgtccctgaagctgagcagcgtgacagccgctgataccgccgtgtactactgcgccagacactactactacggcggcagctacgctatggactattggggccagggcaccaccgtgacagtctcttct

SEQ ID NO: 557 - DNA, 360 bp, Artificial Sequence
  Synthetic Polynucleotide
gaagtgcagctggttgaatcaggtggcggcctggttcaacctggcggatctctgagactgtcttgtgccgccagcggcttcagcttcaacacctacgccatgaactgggtccgacaggctcctggcaaaggactggaatgggtgtcccacatcagaagcaagagcaacaacttcgccacctactacgccgacagcgtgaaggacagattcaccatcagccgggacaacgccaagaacagcctgtacctccagatgaactccctgagagccgaggacaccgccgtgtattattgcgccagacaaggcggcgacttccctatggattattggggccagggcaccctggtcaccgtttcttct

SEQ ID NO: 558 - DNA, 354 bp, Artificial Sequence
  Synthetic Polynucleotide
caggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatct

SEQ ID NO: 559 - DNA, 366 bp, Artificial Sequence
  Synthetic Polynucleotide
gaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctct

SEQ ID NO: 560 - DNA, 360 bp, Artificial Sequence
  Synthetic Polynucleotide
gaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttct

SEQ ID NO: 561 - DNA, 372 bp, Artificial Sequence
  Synthetic Polynucleotide
gaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctcc

SEQ ID NO: 562 - DNA, 354 bp, Artificial Sequence
  Synthetic Polynucleotide
gaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctct

SEQ ID NO: 563 - DNA, 357 bp, Artificial Sequence
  Synthetic Polynucleotide
gaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagc

SEQ ID NO: 564 - DNA, 360 bp, Artificial Sequence
  Synthetic Polynucleotide
gacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgag

SEQ ID NO: 565 - DNA, 375 bp, Artificial Sequence
  Synthetic Polynucleotide
gaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagc

SEQ ID NO: 566 - DNA, 369 bp, Artificial Sequence
  Synthetic Polynucleotide
gaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagc

SEQ ID NO: 567 - DNA, 366 bp, Artificial Sequence
  Synthetic Polynucleotide
gttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagc

SEQ ID NO: 568 - DNA, 372 bp, Artificial Sequence
  Synthetic Polynucleotide
gaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatct

SEQ ID NO: 569 - DNA, 372 bp, Artificial Sequence
  Synthetic Polynucleotide
gaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctct

SEQ ID NO: 570 - DNA, 375 bp, Artificial Sequence
  Synthetic Polynucleotide
gatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagc

SEQ ID NO: 571 - DNA, 378 bp, Artificial Sequence
  Synthetic Polynucleotide
gaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagt

SEQ ID NO: 572 - DNA, 366 bp, Artificial Sequence
  Synthetic Polynucleotide
gaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctcc

SEQ ID NO: 573 - DNA, 336 bp, Artificial Sequence
  Synthetic Polynucleotide
caggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagc

SEQ ID NO: 574 - DNA, 360 bp, Artificial Sequence
  Synthetic Polynucleotide
caggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctct

SEQ ID NO: 575 - DNA, 345 bp, Artificial Sequence
  Synthetic Polynucleotide
gaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagc

SEQ ID NO: 576 - DNA, 348 bp, Artificial Sequence
  Synthetic Polynucleotide
gaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttcc

SEQ ID NO: 577 - DNA, 378 bp, Artificial Sequence
  Synthetic Polynucleotide
gaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagc

SEQ ID NO: 578 - DNA, 363 bp, Artificial Sequence
  Synthetic Polynucleotide
gaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatcc

SEQ ID NO: 579 - DNA, 798 bp, Artificial Sequence
  Synthetic Polynucleotide
gaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagggcggaggcggaagtggaggcggaggatctggcggcggaggctctttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagc

SEQ ID NO: 580 - DNA, 855 bp, Artificial Sequence
  Synthetic Polynucleotide
gaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagggaggaggcggctccgggggaggcggaagtggaggcggaggatctgggtctggaggaagcggatctggaggctcagggtcagggggctcaggcagtggaggctctttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagc

SEQ ID NO: 581 - DNA, 825 bp, Artificial Sequence
  Synthetic Polynucleotide
gaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgagggaggaggcggctccgggggaggcggaagtggaggcggaggatctgggtctggaggaagcggatctggaggctcagggtcagggggctcaggcagtggaggctctttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagc

SEQ ID NO: 582 - DNA, 726 bp, Artificial Sequence
  Synthetic Polynucleotide
gacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatct

SEQ ID NO: 583 - DNA, 840 bp, Artificial Sequence
  Synthetic Polynucleotide
gacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgagggaggaggcggctccgggggaggcggaagtggaggcggaggatctgggtctggaggaagcggatctggaggctcagggtcagggggctcaggcagtggaggctctttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctcc

SEQ ID NO: 584 - DNA, 864 bp, Artificial Sequence
  Synthetic Polynucleotide
gatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcctcgagggaggtagcggctccgggggaggcggaagtggaggcggaggatctgggtctggaggaagcggatctggaggctcagggtcagggggctcaggcagtggaggctctttcgaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagc

SEQ ID NO: 585 - DNA, 813 bp, Artificial Sequence
  Synthetic Polynucleotide
caggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggaggaggcggctccgggggaggcggaagtggaggcggaggatctgggtctggaggaagcggatctggaggctcagggtcagggggctcaggcagtggaggcagcttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctct

SEQ ID NO: 586 - DNA, 357 bp, Artificial Sequence
  Synthetic Polynucleotide
caagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagc

SEQ ID NO: 587 - DNA, 354 bp, Artificial Sequence
  Synthetic Polynucleotide
gaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctct

SEQ ID NO: 588 - DNA, 756 bp, Artificial Sequence
  Synthetic Polynucleotide
caagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagcggaggcggtggaagtggcggcggtggttcaggcggcggaggatctgaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctct

SEQ ID NO: 589 - DNA, 348 bp, Artificial Sequence
  Synthetic Polynucleotide
gaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagt

SEQ ID NO: 590 - DNA, 366 bp, Artificial Sequence
  Synthetic Polynucleotide
caggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctct

SEQ ID NO: 591 - DNA, 735 bp, Artificial Sequence
  Synthetic Polynucleotide
gaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagtgaggtggccgctttggagaaacaggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctct

SEQ ID NO: 592 - DNA, 384 bp, Artificial Sequence
  Synthetic Polynucleotide
caagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagc

SEQ ID NO: 593 - DNA, 357 bp, Artificial Sequence
  Synthetic Polynucleotide
caagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagt

SEQ ID NO: 594 - DNA, 762 bp, Artificial Sequence
  Synthetic Polynucleotide
caagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagcgaggtggccgctttggagaaacaagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagt

SEQ ID NO: 595 - DNA, 351 bp, Artificial Sequence
  Synthetic Polynucleotide
caagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagt

SEQ ID NO: 596 - DNA, 387 bp, Artificial Sequence
  Synthetic Polynucleotide
cctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctct

SEQ ID NO: 597 - DNA, 783 bp, Artificial Sequence
  Synthetic Polynucleotide
caagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagtggaggcggtggaagtggcggcggtggttcaggcggcggaggatctcctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctct

SEQ ID NO: 598 - DNA, 357 bp, Artificial Sequence
  Synthetic Polynucleotide
gccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttct

SEQ ID NO: 599 - DNA, 360 bp, Artificial Sequence
  Synthetic Polynucleotide
caggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctct

SEQ ID NO: 600 - DNA, 738 bp, Artificial Sequence
  Synthetic Polynucleotide
gccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctct

SEQ ID NO: 601 - DNA, 822 bp, Artificial Sequence
  Synthetic Polynucleotide
gccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctgaggttgccgcactggagaaggaagtagccgcgcttgagaaagaggtggcagcgctggagaaagaagttgccgccttggaaaaa

SEQ ID NO: 602 - DNA, 372 bp, Artificial Sequence
  Synthetic Polynucleotide
ggctctgacctgggcatcaagctgctgttcgccgctgccaagggccaggacgacgaagtgcggattctgctggctgctggggccgacgtgaacgccaaggatttcgagggctacacccccctgcacgtggccgcctatgatggacacctggaaatcgtggaagtgctgctgaaggctggcgctgatgtgaatgccaaagacagccagggccggacccctctgcatgaagccgcctacagcggccatctggaaattgtggaagtgctgctgaaagccggggcagacgtgaacgctcaggacgacgctggcgagacaccagccgatctggctgcagcttggggccacgaagatatcgccgaggtgctgcagaag

SEQ ID NO: 603 - DNA, 378 bp, Artificial Sequence
  Synthetic Polynucleotide
agaagcgatctgggaaagaagctgctggaagctgccagagccggacaggatgatgaagtgcgcatcctgatggcaaacggcgcagatgtgaacgcaaaggacgagtacggcctgacccccctgtacctggctacagcccacgggcacctggaaattgtggaagtgctgctgaagaacggcgctgacgtgaacgccgtggacgccatcggctttaccccactgcatctggccgctttcatcgggcatctcgaaatcgcagaggtgctgctgaaacacggggccgatgtgaatgcccaggacaagttcggcaagaccgccttcgacatcagcatcggcaacggcaacgaggacctggccgagatcctgcagaaactgaac

SEQ ID NO: 604 - DNA, 174 bp, Artificial Sequence
  Synthetic Polynucleotide
gtggacaacaagttcaacaaagagcggtacagcgcctactacgagatttggcaactgcccaacctgaacgtgcggcagaaggccgccttcatcggatctctgcaggacgaccctagccagagcgccaatctgctggccgaggccaagaagctgaacgacgcccaggcccctaaa

SEQ ID NO: 605 - DNA, 153 bp, Artificial Sequence
  Synthetic Polynucleotide
tacgccaaagagatgcggaacgcctactgggagatcgccctgctgcccaatctgaccaaccagcagaagagagcccccatcagaaagctgtacgacgacccctcccagagcagcgagctgctgtctgaggctaaaaaactgaacgatagccag

SEQ ID NO: 606 - DNA, 153 bp, Artificial Sequence
  Synthetic Polynucleotide
tatgccaaagaaatgtggattgcctgggaggaaatccgcaacctgcctaatctgaatggctggcagatgaccgcctttatcgctaagctgctggatgaccccagccagtcctctgagctgctgagcgaagcaaagaaactgaatgactcccag

SEQ ID NO: 607 - DNA, 807 bp, Artificial Sequence
  Synthetic Polynucleotide
gaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgaaatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctcgagatcactgctcggccagtactatggcactggctgctgaggactggtggctgg

SEQ ID NO: 608 - DNA, 1470 bp, Artificial Sequence
  Synthetic Polynucleotide
atgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcc

SEQ ID NO: 609 - DNA, 501 bp, Artificial Sequence
  Synthetic Polynucleotide
atggccttaccagtgaccgccttgctcctgccgctggccttgctgctccacgccgccaggccgggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccag

SEQ ID NO: 610 - DNA, 438 bp, Artificial Sequence
  Synthetic Polynucleotide
ggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccag

SEQ ID NO: 611 - DNA, 501 bp, Artificial Sequence
  Synthetic Polynucleotide
atgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaa

SEQ ID NO: 612 - DNA, 486 bp, Artificial Sequence
  Synthetic Polynucleotide
atggcctgtctgggcttccagagacacaaggcccagctcaacctggctaccagaacctggccttgtactctgctgttcttcctgctgttcatccccgtgttctgcaaggccatgcatgtggctcagcctgctgtggtgctggcctctagtagaggaatcgccagcttcgtgtgcgagtacgcctctcctggaaaggccactgaagtgcgcgtgaccgttctgagacaggccgatagccaagtgaccgaagtgtgcgccgccacctacatgatgggcaacgagctgaccttcctggacgacagcatctgtaccggcaccagcagcggcaatcaagtgaacctgaccatccagggcctgagagctatggacaccggcctgtacatctgcaaggtggaactgatgtaccctcctccttactacctcggcatcggcaacggcacccaaatctacgtgatcgaccccgagccttgtcctgacagcgatttc

SEQ ID NO: 613 - DNA, 723 bp, Artificial Sequence
  Synthetic Polynucleotide
atgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggg

SEQ ID NO: 614 - DNA, 900 bp, Artificial Sequence
  Synthetic Polynucleotide
atggtgctgctgtggctgaccctgctgctgatcgccctgccttgtctgctgcagaccaaagaggaccccaacccccccatcaccaacctgcggatgaaggccaaagcccagcaactgacctgggacctgaaccggaacgtgaccgacatcgagtgcgtgaaggacgccgactactccatgcccgccgtgaacaacagctactgccagttcggagccatcagcctgtgcgaagtgaccaactacaccgtgcgggtggcaaacccccccttctccacctggattctgttccccgagaacagcggcaagccctgggctggcgctgagaatctgacctgctggattcacgacgtggactttctgagctgctcctgggctgtgggacctggcgctcctgccgatgtgcagtacgacctgtacctgaatgtggctaaccggcggcagcagtacgagtgcctgcactacaagaccgacgcccagggcaccagaatcggctgcagattcgacgacatcagcagactgagcagcggcagccagtccagccacatccttgtgcggggaagaagcgccgccttcggcatcccttgcaccgacaagttcgtggtgttcagccagatcgagatcctgaccccccccaacatgaccgccaagtgcaacaagacccacagcttcatgcactggaagatgcggagccacttcaaccggaagttcagatacgagctgcagatccagaaacggatgcagcccgtgattaccgaacaagtgcgggaccggaccagcttccaactgctgaaccctggcacctacacagtgcagatccgggccagagaacgggtgtacgagttcctgagcgcctggtccaccccccagagattcgagtgcgatcaggaagagggggccaac

SEQ ID NO: 615 - DNA, 2127 bp, Artificial Sequence
  Synthetic Polynucleotide
atgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgcc

SEQ ID NO: 616 - DNA, 717 bp, Artificial Sequence
  Synthetic Polynucleotide
atgtcagctccaagattactgatttccatcattatcatggtgtctgcttcaagtagttcatgcatgggtggaaagcagatgacacagaactattcaacaatttttgcagaaggtaacatttcacagcctgtactgatggatataaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgttgagagaataacctgggtctctagacctgatcagaattcggaccttcagattcttccggtggacaccactcatgacgggtattacagaggcatagtggtaacacctgatgggaatttccatcgtggatatcacctccaagtgttagttacacccgaagtgaacctatttcaaagcaggaatataactgcagtatgcaaggcagttacagggaagccagctgcccagatctcctggatcccagagggatctattcttgccactaagcaagaatactggggcaatggcacagtgacggttaagagtacatgcccctgggagggccacaagtctactgtgacctgccatgtctcccatttgactggcaacaagagtctgtccgtaaagttgaattcaggtctcagaacctcaggatctccagcgttgtccttactg

SEQ ID NO: 617 - DNA, 1464 bp, Artificial Sequence
  Synthetic Polynucleotide
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagcgcc

SEQ ID NO: 618 - DNA, 1992 bp, Artificial Sequence
  Synthetic Polynucleotide
atgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagacc

SEQ ID NO: 619 - DNA, 756 bp, Artificial Sequence
  Synthetic Polynucleotide
atgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagag

SEQ ID NO: 620 - DNA, 870 bp, Artificial Sequence
  Synthetic Polynucleotide
atgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagacc

SEQ ID NO: 621 - DNA, 804 bp, Artificial Sequence
  Synthetic Polynucleotide
atggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaacaggcgcgc

SEQ ID NO: 622 - DNA, 795 bp, Artificial Sequence
  Synthetic Polynucleotide
atgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaacaaagaatgatatgtgagaagatggccaatccagtgcagcttggttctacatattttagggaggca

SEQ ID NO: 623 - DNA, 489 bp, Artificial Sequence
  Synthetic Polynucleotide
atggccttaccagtgaccgccttgctcctgccgctggccttgctgctccacgccgccaggccgttcgaatgtcctgccggcatctacgcccctatctgttctggcggagggggatcttgtgggggaggcggcagcaagatcagccacttcctgaagatggaaagcctgaacttcatcagagcccacaccccctacatcaacatctacaactgcgagcccgccaaccccagcgagaagaacagccccagcacccagtattgctacagcatccagagcggaggcggcggaagttgtggaggcggaggctctcctgctggaatctatgctcctatcggaggcggaggctccaagatttcccactttctgaaaatggaatctctgaatttcatccgggctcacacaccttacatcaatatctataactgcgaacctgccaatccctctgagaagaactccccatccacacagtattgctattccatccagtcc

SEQ ID NO: 624 - DNA, 315 bp, Artificial Sequence
  Synthetic Polynucleotide
atggccttaccagtgaccgccttgctcctgccgctggccttgctgctccacgccgccaggccgttcgaatgtcctgccggcatctacgcccctatctgttctggcggagggggatcttgtgggggaggcggcagcaagatcagccacttcctgaagatggaaagcctgaacttcatcagagcccacaccccctacatcaacatctacaactgcgagcccgccaaccccagcgagaagaacagccccagcacccagtattgctacagcatccagagcggaggcggcggaagttgtggaggcggaggctctacgcgt

SEQ ID NO: 625 - DNA, 1545 bp, Artificial Sequence
  Synthetic Polynucleotide
atgtctctgtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcga

SEQ ID NO: 626 - DNA, 1239 bp, Artificial Sequence
  Synthetic Polynucleotide
atgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttattcttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggc

SEQ ID NO: 627 - DNA, 1083 bp, Artificial Sequence
  Synthetic Polynucleotide
atgcgaccctccgggacggccggggcagcgctcctggcgctgctggctgcgctctgcccggcgagtcgggctctggaggaaaagaaaggtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgc

SEQ ID NO: 628 - DNA, 163 bp, Artificial Sequence
  Synthetic Polynucleotide
atgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcga

SEQ ID NO: 629 - DNA, 678 bp, Artificial Sequence
  Synthetic Polynucleotide
atggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatg

SEQ ID NO: 630 - DNA, 405 bp, Artificial Sequence
  Synthetic Polynucleotide
ctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtg

SEQ ID NO: 631 - DNA, 561 bp, Artificial Sequence
  Synthetic Polynucleotide
atggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggaccctaatgccatcttcctgagcttccaacacctgctccgaggaaaggtgcgtttcctgatgcttgtaggagggtccaccctctgcgtcaggcgggccccacccaccacagctgtccccagcagaacctct

SEQ ID NO: 632 - DNA, 561 bp, Artificial Sequence
  Synthetic Polynucleotide
atggagctgactgatttgctcctggcggccatgcttcttgcagtggcaagactaactctgtccagccccgtagctcctgcctgtgaccccagactcctaaataaactgctgcgtgactcccacctccttcacagccgactgagtcagtgtcccgacgtggaccctttgtctatccctgttctgctgcctgctgtggactttagcctgggagaatggaaaacccagacggaacagagcaaggcacaggacattctaggggcagtgtcccttctactggagggagtgatggcagcacgaggacagttggaaccctcctgcctctcatccctcctgggacagctttctgggcaggttcgcctcctcttgggggccctgcagggcctcctaggaacccagcttcctctacagggcaggaccacagctcacaaggaccccaatgccctcttcttgagcttgcaacaactgcttcggggaaaggtgcgcttcctgcttctggtagaaggtcccaccctctgtgtcagacggaccctgccaaccacagctgtcccaagcagtacttct

SEQ ID NO: 633 - DNA, 276 bp, Artificial Sequence
  Synthetic Polynucleotide
gctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagc

SEQ ID NO: 634 - DNA, 495 bp, Artificial Sequence
  Synthetic Polynucleotide
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaa

SEQ ID NO: 635 - DNA, 333 bp, Artificial Sequence
  Synthetic Polynucleotide
aacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaa

SEQ ID NO: 636 - DNA, 423 bp, Artificial Sequence
  Synthetic Polynucleotide
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttctt

SEQ ID NO: 637 - DNA, 414 bp, Artificial Sequence
  Synthetic Polynucleotide
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgtt

SEQ ID NO: 638 - DNA, 816 bp, Artificial Sequence
  Synthetic Polynucleotide
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagc

SEQ ID NO: 639 - DNA, 717 bp, Artificial Sequence
  Synthetic Polynucleotide
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagc

SEQ ID NO: 640 - DNA, 744 bp, Artificial Sequence
  Synthetic Polynucleotide
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttcttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagc

SEQ ID NO: 641 - DNA, 735 bp, Artificial Sequence
  Synthetic Polynucleotide
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagc

SEQ ID NO: 642 - DNA, 726 bp, Artificial Sequence
  Synthetic Polynucleotide
gacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctca

SEQ ID NO: 643 - DNA, 726 bp, Artificial Sequence
  Synthetic Polynucleotide
gagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagt

SEQ ID NO: 644 - DNA, 729 bp, Artificial Sequence
  Synthetic Polynucleotide
gacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagt

SEQ ID NO: 645 - DNA, 750 bp, Artificial Sequence
  Synthetic Polynucleotide
gacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagt

SEQ ID NO: 646 - DNA, 747 bp, Artificial Sequence
  Synthetic Polynucleotide
gacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagaggcggaggcggaagtggaggcggaggatctggcggcggaggctctgaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctct

SEQ ID NO: 647 - DNA, 747 bp, Artificial Sequence; identical to SEQ ID NO: 646
  Synthetic Polynucleotide

SEQ ID NO: 648 - DNA, 747 bp, Artificial Sequence; identical to SEQ ID NO: 646
  Synthetic Polynucleotide

SEQ ID NO: 649 - DNA, 801 bp, Artificial Sequence
  Synthetic Polynucleotide
atcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttct

SEQ ID NO: 650 - DNA, 747 bp, Artificial Sequence
  Synthetic Polynucleotide
gacatcctgctgacacagtctcccgccacactgtcactgtctccaggcgaaagagccacactgagctgtagagccagccagagcgtggactacgacggcgacagctacctgaactggtatcagcagaagcccggccagcctcctaagctgctgatctacgatgccagcaacctggtgtctggcatccctcctagattttccggcagcggctctggcaccgatttcaccctgaccatcagcagactggaacccgaggacttcgccgtgtaccactgtcagcagagcacagaggacccctggacatttggcggaggcaccaagctggaaatcaaaggcggaggcggaagtggaggcggaggatctggcggcggaggctctcaggtgcagctggttgaatctggcggcggacttgttgagcctggcggatctctgagactgagctgcatgagcggctacgccttcagcagctactggatgaactgggtccgacagatgcccggcaaaggactggaatggatgggccagatttggcctggcgacggcgataccaactacaaccccagcctgaagtccagagtgaccatcaccgccgatgagagcaccagcaccgcctacatggaactgtctagcctgaaggccgaggatacagccgtgtacttctgcgccagacgggaaaccacaaccgtgggcagatattactacgctatggactactggggccagggcaccctggttacagtctcttct

SEQ ID NO: 651 - DNA, 738 bp, Artificial Sequence
  Synthetic Polynucleotide
gacatcctgctgacacagtctcccgccacactgtcactgtctccaggcgaaagagccacactgagctgtagagccagccagagcgtggacaactacggcatcagcttcatgaactggtatcagcagaagcccggccagcctcctaagctgctgatctacgccgccagcaatcaaggctctggcatccccagcagattttccggctctggaagcggcaccgacttcaccctgaccataagcagcctggaacctgaggacttcgccatgtacttttgccagcagagcaacgaggtgcccagaacctttggcggaggcaccaagctggaaatcaaaggcggaggcggaagtggaggcggaggatctggcggcggaggctctcaggtgcaactggttgagtctggcggcggacttgttgaacctggcggaagcctgagactgagctgcatgagcggctacgcctttagcagctcctggatgaactgggtccgacagatgcctggcaaaggactggaatggatgggcagaatctaccccggcgacggcgacaccaactacaacggcaagttcaaagaacgggtcaccatcaccgccgacgagagcacaagcaccgcctacatggaactgagcagcctgaaggccgaggataccgccgtgtacttctgcgccagaagcgagtattggggcaactactgggctatggactactggggccagggcacactggtcacagtgtctagc

SEQ ID NO: 652 - DNA, 735 bp, Artificial Sequence
  Synthetic Polynucleotide
gacatcctgctgacacagtctcccgccacactgtcactgtctccaggcgaaagagccacactgagctgcaaggccagtcagaacgtgggcacaaacgtggcctggtatcagcagaagcctggacagcctcctaagctgctgatctacagcgccacctaccggaactctggcatccctgccagattttctggcagcggctctggcaccgagttcaccctgaccatcaccaacgtgcagagcaaggacctggccgactacttctacttctgccagtacaacagatacccctacaccagcggcggaggcaccaagctggaaatcaaaagaggcggaggcggaagtggaggcggaggatctggcggcggaggctctcaggtgcaactggttgaatcaggcggaggactggtggaacctggcggatctctgagactgagctgtatgagcggctacgccttcagcagctactggatgaactgggtccgacagatgcccggcaaaggactggaatggatgggccaaatctaccccggcgacggcgacaccaactacaacggcaagttcaagggcagagtgacaatcaccgccgacgagagcacaagcaccgcctacatggaactgagcagcctgaaggccgaggataccgccgtgtacttctgcgccagaaagaccatcagcagcgtggtggatttctacttcgacaactggggccagggcaccctggtcacagtttcttct

SEQ ID NO: 653 - DNA, 774 bp, Artificial Sequence
  Synthetic Polynucleotide
atcaacatctacaacgccgagcctgccaatcctagcgagaagaacagccccgaattccagatcgtgctgacacagtctccagccacactgagcgcttctccaggcgagaaggccaccatgacatgttctgccagcagcggcgtgaactacatgcactggtatcagcagaagcccggcacaagccccaagcggtggatctacgataccgacaagacagccagcggagtgcccgccagattttctggctctggcagcggcacatcctacagcctgacaatcagcagcatggaagccgaggatgccgccacctactactgtcaccagagaggcagctacaccttcggcggaggcaccaagctggaaatcaaaggcggaggcggaagtggaggcggaggatctggcggcggaggctctcaagttcagctggaacaacctggcgctgaggtggtcaaaccaggggcctctgtgaaggtgtcctgcaagacaagcggctacacattcaccagcaactggatgcactgggtcaagcagacccctggcaaaggactggaatggatcggcgagatcgaccccagcgactcctacaccaactacaaccagaagttcgacggcaaggccaagctgaccgtggacaagtctagcagcaccgcctacatggaagtgtccgatctgaccgccgaagatagcgccacatattactgcgccagaggcagcaacccctactactacgctatggactattggggccagggcaccagcgtgacagtctcttct

SEQ ID NO: 654 - DNA, 732 bp, Artificial Sequence
  Synthetic Polynucleotide
gacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagt

SEQ ID NO: 655 - DNA, 756 bp, Artificial Sequence
  Synthetic Polynucleotide
gacgacatccagctgacccagagccccagcagcctgagcgccagcgtgggcgacagagtgaccatcacctgcaaggccagccagagcgtggactacgacggcgacagctacctgaactggtaccagcagatccccggcaaggcccccaagctgctgatctacgacgccagcaacctggtgagcggcatcccccccagattcagcggcagcggcagcggcaccgactacaccttcaccatcagcagcctgcagcccgaggacatcgccacctaccactgccagcagagcaccgaggacccctggaccttcggcggcggcaccaagctgcagatcaagagaggcggaggcggaagtggaggcggaggatctggcggcggaggctctcaggtgcagctgcagcagagcggcgccgaggtgaagaagcccggcagcagcgtgaaggtgagctgcaaggccagcggctacgccttcagcagctactggatgaactgggtgagacagagacccggccagggcctggagtggatcggccagatttggcccggcgacggcgacaccaactacaacggcaagttcaagggcagagccaccatcaccgccgacgagagcaccaacaccgcctacatggagctgagcagcctgagaagcgaggacaccgccttctacagctgcgccagaagagagaccaccaccgtgggcagatactactacgctatggactactggggccagggcaccaccgtgaccgtgagcagc

SEQ ID NO: 656 - DNA, 729 bp, Artificial Sequence
  Synthetic Polynucleotide
cagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagt

SEQ ID NO: 657 - DNA, 747 bp, Artificial Sequence
  Synthetic Polynucleotide
cagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatct

SEQ ID NO: 658 - DNA, 762 bp, Artificial Sequence
  Synthetic Polynucleotide
cagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttct

SEQ ID NO: 659 - DNA, 720 bp, Artificial Sequence
  Synthetic Polynucleotide
tacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgct

SEQ ID NO: 660 - DNA, 753 bp, Artificial Sequence
  Synthetic Polynucleotide
gacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctct

SEQ ID NO: 661 - DNA, 726 bp, Artificial Sequence
  Synthetic Polynucleotide
gacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagt

SEQ ID NO: 662 - DNA, 750 bp, Artificial Sequence
  Synthetic Polynucleotide
gatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaaggcggaggcggaagtggaggcggaggatctggcggcggaggctctgaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctcc

SEQ ID NO: 663 - DNA, 738 bp, Artificial Sequence
  Synthetic Polynucleotide
gacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctca

SEQ ID NO: 664 - DNA, 732 bp, Artificial Sequence
  Synthetic Polynucleotide
gacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagc

SEQ ID NO: 665 - DNA, 732 bp, Artificial Sequence
  Synthetic Polynucleotide
gacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctct

SEQ ID NO: 666 - DNA, 735 bp, Artificial Sequence
  Synthetic Polynucleotide
cagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatct

SEQ ID NO: 667 - DNA, 729 bp, Artificial Sequence
  Synthetic Polynucleotide
caggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatct

SEQ ID NO: 668 - DNA, 762 bp, Artificial Sequence
  Synthetic Polynucleotide
ctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatct

SEQ ID NO: 669 - DNA, 729 bp, Artificial Sequence
  Synthetic Polynucleotide
gacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttct

SEQ ID NO: 670 - DNA, 732 bp, Artificial Sequence
  Synthetic Polynucleotide
gacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagt

SEQ ID NO: 671 - DNA, 735 bp, Artificial Sequence
  Synthetic Polynucleotide
gacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctct

SEQ ID NO: 672 - DNA, 735 bp, Artificial Sequence
  Synthetic Polynucleotide
gaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagc

SEQ ID NO: 673 - DNA, 735 bp, Artificial Sequence; identical to SEQ ID NO: 672
  Synthetic Polynucleotide

SEQ ID NO: 674 - DNA, 732 bp, Artificial Sequence
  Synthetic Polynucleotide
gagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatct

SEQ ID NO: 675 - DNA, 741 bp, Artificial Sequence
  Synthetic Polynucleotide
gacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagc

SEQ ID NO: 676 - DNA, 744 bp, Artificial Sequence
  Synthetic Polynucleotide
gacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagc

SEQ ID NO: 677 - DNA, 732 bp, Artificial Sequence
  Synthetic Polynucleotide
gacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttct

SEQ ID NO: 678 - DNA, 741 bp, Artificial Sequence
  Synthetic Polynucleotide
gagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttct

SEQ ID NO: 679 - DNA, 735 bp, Artificial Sequence
  Synthetic Polynucleotide
gagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttct

SEQ ID NO: 680 - DNA, 732 bp, Artificial Sequence
  Synthetic Polynucleotide
gacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttct

SEQ ID NO: 681 - DNA, 726 bp, Artificial Sequence
  Synthetic Polynucleotide
gacatccagctcacacagagcccttctagcctgtctgccagcgtgggcgatagagtgaccatgacctgtagagccagcagcagcgtgtcctacatccactggttccagcagaagcctggcaaggcccctaagccttggatctacgccaccagcaatctggcctctggcgtgccagtcagattttctggcagcggctctggcaccgactacaccttcacaatatccagcctccagcctgaggacattgccacctactactgccagcagtggacctccaatcctcctacctttggcggaggcaccaagctggaaatcaaaggcggaggcggaagtggaggcggaggatctggcggcggaggctctcaggttcagctccagcagtctggggccgaagtgaagaaacctggcagctccgtgaaagtgtcctgcaaggccagcggctacacctttaccagctacaacatgcactgggtcaagcaggcccctggacagggactcgaatggatcggagccatctatcccggcaacggcgacacctcctacaaccagaagttcaagggcaaagccacactgaccgccgacgagagcacaaacaccgcctacatggaactgagcagcctgagaagcgaggacaccgccttctactactgtgcccggtctacctactacggcggcgactggtactttgacgtgtggggccagggaaccaccgtgacagtttcttct

SEQ ID NO: 682 - DNA, 762 bp, Artificial Sequence
  Synthetic Polynucleotide
agcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaacc

SEQ ID NO: 683 - DNA, 738 bp, Artificial Sequence
  Synthetic Polynucleotide
cagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagc

SEQ ID NO: 684 - DNA, 732 bp, Artificial Sequence; identical to SEQ ID NO: 680
  Synthetic Polynucleotide

SEQ ID NO: 685 - DNA, 729 bp, Artificial Sequence
  Synthetic Polynucleotide
gagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttct

SEQ ID NO: 686 - DNA, 735 bp, Artificial Sequence
  Synthetic Polynucleotide
gacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttct

SEQ ID NO: 687 - DNA, 786 bp, Artificial Sequence
  Synthetic Polynucleotide
gacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctttcgaagccgagcccgccaaccccagcgagaagaacagccccggcggatctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttct

SEQ ID NO: 688 - DNA, 729 bp, Artificial Sequence
  Synthetic Polynucleotide
gagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttct

SEQ ID NO: 689 - DNA, 720 bp, Artificial Sequence
  Synthetic Polynucleotide
gacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctct

SEQ ID NO: 690 - DNA, 738 bp, Artificial Sequence
  Synthetic Polynucleotide
gacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagc

SEQ ID NO: 691 - DNA, 738 bp, Artificial Sequence
  Synthetic Polynucleotide
caggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaag

SEQ ID NO: 692 - DNA, 717 bp, Artificial Sequence
  Synthetic Polynucleotide
gacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagc

SEQ ID NO: 693 - DNA, 729 bp, Artificial Sequence
  Synthetic Polynucleotide
gagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctct

SEQ ID NO: 694 - DNA, 723 bp, Artificial Sequence
  Synthetic Polynucleotide
gacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatct

SEQ ID NO: 695 - DNA, 750 bp, Artificial Sequence
  Synthetic Polynucleotide
gacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctct

SEQ ID NO: 696 - DNA, 738 bp, Artificial Sequence
  Synthetic Polynucleotide
gagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatct

SEQ ID NO: 697 - DNA, 819 bp, Artificial Sequence
  Synthetic Polynucleotide
tacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctcc

SEQ ID NO: 698 - DNA, 816 bp, Artificial Sequence
  Synthetic Polynucleotide
tacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaaga

SEQ ID NO: 699 - DNA, 717 bp, Artificial Sequence
  Synthetic Polynucleotide
gacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagt

SEQ ID NO: 700 - DNA, 732 bp, Artificial Sequence
  Synthetic Polynucleotide
gagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctct

SEQ ID NO: 701 - DNA, 729 bp, Artificial Sequence
  Synthetic Polynucleotide
gacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagc

SEQ ID NO: 702 - DNA, 720 bp, Artificial Sequence
  Synthetic Polynucleotide
gacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttct

SEQ ID NO: 703 - DNA, 750 bp, Artificial Sequence
  Synthetic Polynucleotide
gatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctct

SEQ ID NO: 704 - DNA, 708 bp, Artificial Sequence
  Synthetic Polynucleotide
gagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctct

SEQ ID NO: 705 - DNA, 735 bp, Artificial Sequence
  Synthetic Polynucleotide
gacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctct

SEQ ID NO: 706 - DNA, 723 bp, Artificial Sequence
  Synthetic Polynucleotide
gacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagc

SEQ ID NO: 707 - DNA, 723 bp, Artificial Sequence
  Synthetic Polynucleotide
gacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagt

SEQ ID NO: 708 - DNA, 747 bp, Artificial Sequence
  Synthetic Polynucleotide
gacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagc

SEQ ID NO: 709 - DNA, 732 bp, Artificial Sequence
  Synthetic Polynucleotide
gacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttct

SEQ ID NO: 710 - DNA, 744 bp, Artificial Sequence
  Synthetic Polynucleotide
gacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctct

SEQ ID NO: 711 - DNA, 744 bp, Artificial Sequence
  Synthetic Polynucleotide
gacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctct

SEQ ID NO: 712 - DNA, 726 bp, Artificial Sequence
  Synthetic Polynucleotide
gagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagt

SEQ ID NO: 713 - DNA, 732 bp, Artificial Sequence
  Synthetic Polynucleotide
cagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttct

SEQ ID NO: 714 - DNA, 723 bp, Artificial Sequence
  Synthetic Polynucleotide
gacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttct

SEQ ID NO: 715 - DNA, 726 bp, Artificial Sequence
  Synthetic Polynucleotide
gagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttct

SEQ ID NO: 716 - DNA, 714 bp, Artificial Sequence
  Synthetic Polynucleotide
gacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagt

SEQ ID NO: 717 - DNA, 807 bp, Artificial Sequence
  Synthetic Polynucleotide
tacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttct

SEQ ID NO: 718 - DNA, 720 bp, Artificial Sequence
  Synthetic Polynucleotide
gagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagt

SEQ ID NO: 719 - DNA, 747 bp, Artificial Sequence
  Synthetic Polynucleotide
gacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctct

SEQ ID NO: 720 - DNA, 759 bp, Artificial Sequence
  Synthetic Polynucleotide
gacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttct

SEQ ID NO: 721 - DNA, 732 bp, Artificial Sequence
  Synthetic Polynucleotide
gacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagc

SEQ ID NO: 722 - DNA, 717 bp, Artificial Sequence
  Synthetic Polynucleotide
gacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctct

SEQ ID NO: 723 - DNA, 726 bp, Artificial Sequence
  Synthetic Polynucleotide
gagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagc

SEQ ID NO: 724 - DNA, 711 bp, Artificial Sequence
  Synthetic Polynucleotide
cagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgct

SEQ ID NO: 725 - DNA, 741 bp, Artificial Sequence
  Synthetic Polynucleotide
gacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagt

SEQ ID NO: 726 - DNA, 717 bp, Artificial Sequence
  Synthetic Polynucleotide
gacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctct

SEQ ID NO: 727 - DNA, 726 bp, Artificial Sequence
  Synthetic Polynucleotide
gacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatct

SEQ ID NO: 728 - DNA, 756 bp, Artificial Sequence
  Synthetic Polynucleotide
gacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagt

SEQ ID NO: 729 - DNA, 747 bp, Artificial Sequence
  Synthetic Polynucleotide
gagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatct

SEQ ID NO: 730 - DNA, 723 bp, Artificial Sequence
  Synthetic Polynucleotide
gacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgct

SEQ ID NO: 731 - DNA, 702 bp, Artificial Sequence
  Synthetic Polynucleotide
atgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatct

SEQ ID NO: 732 - DNA, 717 bp, Artificial Sequence
  Synthetic Polynucleotide
cagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctct

SEQ ID NO: 733 - DNA, 726 bp, Artificial Sequence
  Synthetic Polynucleotide
gacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctct

SEQ ID NO: 734 - DNA, 741 bp, Artificial Sequence
  Synthetic Polynucleotide
gacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctct

SEQ ID NO: 735 - DNA, 726 bp, Artificial Sequence
  Synthetic Polynucleotide
gacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagt

SEQ ID NO: 736 - DNA, 744 bp, Artificial Sequence
  Synthetic Polynucleotide
gacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatct

SEQ ID NO: 737 - DNA, 738 bp, Artificial Sequence
  Synthetic Polynucleotide
gagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttct

SEQ ID NO: 738 - DNA, 738 bp, Artificial Sequence
  Synthetic Polynucleotide
gagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttct

SEQ ID NO: 739 - DNA, 774 bp, Artificial Sequence
  Synthetic Polynucleotide
gacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctggcggaggcggaagtggaggcggaggatctggcggcggaggctctcaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagc

SEQ ID NO: 740 - DNA, 732 bp, Artificial Sequence
  Synthetic Polynucleotide
gacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctca

SEQ ID NO: 741 - DNA, 723 bp, Artificial Sequence
  Synthetic Polynucleotide
gacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatct

SEQ ID NO: 742 - DNA, 726 bp, Artificial Sequence
  Synthetic Polynucleotide
gacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagc

SEQ ID NO: 743 - DNA, 732 bp, Artificial Sequence
  Synthetic Polynucleotide
gacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatct

SEQ ID NO: 744 - DNA, 735 bp, Artificial Sequence
  Synthetic Polynucleotide
gacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttct

SEQ ID NO: 745 - DNA, 735 bp, Artificial Sequence
  Synthetic Polynucleotide
gacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttct

SEQ ID NO: 746 - DNA, 735 bp, Artificial Sequence
  Synthetic Polynucleotide
gacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttct

SEQ ID NO: 747 - DNA, 729 bp, Artificial Sequence
  Synthetic Polynucleotide
gacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgct

SEQ ID NO: 748 - DNA, 729 bp, Artificial Sequence
  Synthetic Polynucleotide
gacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatct

SEQ ID NO: 749 - DNA, 744 bp, Artificial Sequence
  Synthetic Polynucleotide
cagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagc

SEQ ID NO: 750 - DNA, 744 bp, Artificial Sequence
  Synthetic Polynucleotide
cagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagc

SEQ ID NO: 751 - DNA, 738 bp, Artificial Sequence
  Synthetic Polynucleotide
gacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagt

SEQ ID NO: 752 - DNA, 723 bp, Artificial Sequence
  Synthetic Polynucleotide
gagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctct

SEQ ID NO: 753 - DNA, 723 bp, Artificial Sequence
  Synthetic Polynucleotide
agcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccggcggaggcggaagtggaggcggaggatctggcggcggaggctctgaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtcc

SEQ ID NO: 754 - DNA, 735 bp, Artificial Sequence
  Synthetic Polynucleotide
gaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgggcggaggcggaagtggaggcggaggatctggcggcggaggctctgacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagc

SEQ ID NO: 755 - DNA, 708 bp, Artificial Sequence
  Synthetic Polynucleotide
gacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctct

SEQ ID NO: 756 - DNA, 723 bp, Artificial Sequence
  Synthetic Polynucleotide
gagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaag

SEQ ID NO: 757 - DNA, 744 bp, Artificial Sequence
  Synthetic Polynucleotide
gagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagt

SEQ ID NO: 758 - DNA, 747 bp, Artificial Sequence
  Synthetic Polynucleotide
gagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatct

SEQ ID NO: 759 - DNA, 738 bp, Artificial Sequence
  Synthetic Polynucleotide
gacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagt

SEQ ID NO: 760 - DNA, 732 bp, Artificial Sequence
  Synthetic Polynucleotide
gacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtct

SEQ ID NO: 761 - DNA, 765 bp, Artificial Sequence
  Synthetic Polynucleotide
gacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctaca

SEQ ID NO: 762 - DNA, 753 bp, Artificial Sequence
  Synthetic Polynucleotide
caggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttgga

SEQ ID NO: 763 - DNA, 738 bp, Artificial Sequence
  Synthetic Polynucleotide
gacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaaggcggaggcggaagtggaggcggaggatctggcggcggaggctctcaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagt

SEQ ID NO: 764 - DNA, 735 bp, Artificial Sequence
  Synthetic Polynucleotide
gacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagt

SEQ ID NO: 765 - DNA, 747 bp, Artificial Sequence
  Synthetic Polynucleotide
gacctggaaaccaccctgacacagagccctgccaccctgagtgtgtccccaggcgagagagtgaccctgagctgtagagccagccagagcgtgggcagcaacctggcctggtatcagcagaagttcggccaggcccccagactgctgatctacgacgccagcacaagagccaccggcatccccgccagattttctggcagcggctccggcaccgagttcaccctgaccatcagcagactggaacccgaggacttcgccgtgtactactgccaccagtacggcagcagccccagaacctttggacagggcaccaaggtggacatcaagcggggcggaggcggaagtggaggcggaggatctggcggcggaggctctcaggtgcaactggtgcagagcggagccgaagtgaagaaacctggggccagcgtgaaggtgtcctgcaaggccagcggctacacctttaccacctacggcatctcttgggtgcgccaggctcctggacagggactggaatggatgggctggatcagcgcctacaacggccacaccaactacgcccagatgctccagggcagagtgaccatgaccaccgacaccagcacctccaccgcctacatggaactgcggggcctgagaagcgacgacaccgccgtgtattattgcgccagagaagcctacgcctcctacggcagcggcagctactggaccgattattggggccagggcaccctcgtgaccgtgtctagt

SEQ ID NO: 766 - DNA, 723 bp, Artificial Sequence
  Synthetic Polynucleotide
gacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagt

SEQ ID NO: 767 - DNA, 717 bp, Artificial Sequence
  Synthetic Polynucleotide
gagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctct

SEQ ID NO: 768 - DNA, 726 bp, Artificial Sequence
  Synthetic Polynucleotide
gacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatct

SEQ ID NO: 769 - DNA, 732 bp, Artificial Sequence
  Synthetic Polynucleotide
cagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatct

SEQ ID NO: 770 - DNA, 747 bp, Artificial Sequence
  Synthetic Polynucleotide
cagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagc

SEQ ID NO: 771 - DNA, 729 bp, Artificial Sequence
  Synthetic Polynucleotide
gacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatct

SEQ ID NO: 772 - DNA, 732 bp, Artificial Sequence
  Synthetic Polynucleotide
gacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagc

SEQ ID NO: 773 - DNA, 729 bp, Artificial Sequence
  Synthetic Polynucleotide
cagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttct

SEQ ID NO: 774 - DNA, 726 bp, Artificial Sequence
  Synthetic Polynucleotide
cagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtg

SEQ ID NO: 775 - DNA, 726 bp, Artificial Sequence
  Synthetic Polynucleotide
cagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttct

SEQ ID NO: 776 - DNA, 732 bp, Artificial Sequence
  Synthetic Polynucleotide
cagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatct

SEQ ID NO: 777 - DNA, 726 bp, Artificial Sequence
  Synthetic Polynucleotide
gacaacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagagaggcggaggcggaagtggaggcggaggatctggcggcggaggctctcaagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatct

SEQ ID NO: 778 - DNA, 756 bp, Artificial Sequence
  Synthetic Polynucleotide
gacaacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacagggcggaggcggaagtggaggcggaggatctggcggcggaggctctgaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctct

SEQ ID NO: 779 - DNA, 726 bp, Artificial Sequence
  Synthetic Polynucleotide
gacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgct

SEQ ID NO: 780 - DNA, 723 bp, Artificial Sequence
  Synthetic Polynucleotide
gacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagt

SEQ ID NO: 781 - DNA, 726 bp, Artificial Sequence
  Synthetic Polynucleotide
gacatcgtgctgacccagagccccgccagcctggccgtgagcctgggccagagcgtgaccatcagctgcagagccagcgagagcgtggagtactacggcaccagcctgatgcagtggtaccagcagaagcccggccagccccccaagctgctgatctacgccaccagcaacgtggagagcggcgtgcccgccagattcagcggcagcggcagcggcaccgacttcagcctgaacatccaccccgtggaggaggacgacatcgccatgtacttctgccagcagagcagaaagctgcccagcaccttcggcggcggcaccaagctggagatcaagggcggaggcggaagtggaggcggaggatctggcggcggaggctctgacgtgagactgcaggagagcggccccggccaggtgaagcccagccagaccgtgagcctgacctgcagcgtgaccggctacagcatcaccaacggcaaccactggtggaactggatcagacaggtgagcggcagcaagctggagtggatcggctacatcagcagcagcggcagcaccgacagcaaccccagcctgaagagcagaatcagcatcaccagagacaccagcaagaaccagctgttcctgcagctgaacagcgtgaccaccgaggacatcgccacctactactgcgccagaggctactacttcgactactggggccagggcaccaccctgaccgtgagcagc

SEQ ID NO: 782 - DNA, 723 bp, Artificial Sequence
  Synthetic Polynucleotide
gaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctct

SEQ ID NO: 783 - DNA, 747 bp, Artificial Sequence
  Synthetic Polynucleotide
gacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggaccc

SEQ ID NO: 784 - DNA, 765 bp, Artificial Sequence
  Synthetic Polynucleotide
cagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagc

SEQ ID NO: 785 - DNA, 720 bp, Artificial Sequence
  Synthetic Polynucleotide
gagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagc

SEQ ID NO: 786 - DNA, 750 bp, Artificial Sequence
  Synthetic Polynucleotide
gagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctca

SEQ ID NO: 787 - DNA, 738 bp, Artificial Sequence
  Synthetic Polynucleotide
gacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttct

SEQ ID NO: 788 - DNA, 735 bp, Artificial Sequence
  Synthetic Polynucleotide
gacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagagaggcggaggcggaagtggaggcggaggatctggcggcggaggctctgaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagc

SEQ ID NO: 789 - DNA, 750 bp, Artificial Sequence
  Synthetic Polynucleotide
agctacgagctgacacagcctccatccgtgtctggcacacctggacagagagtggctatctcctgtagcggcagcagcagcaacatcggcaccagaatggtcacctggtatcagcacgtgccaggcacagcccctaagctgctgatcttcaacaacaaccagcggcctagcggcgtgcccgatagattttctgccagcaagagcggcacaagcgccagcctggctatcatcggactccagtctgacgacgaggccgactactactgtgccacctgggacgacaacgtgaagtcctacgtgttcggcaccggcaccaaagtgacagtgcttggaagtagaggcggaggcggaagtggaggcggaggatctggcggcggaggctctcttgaaatggcccaggttcagctccagcagtggggagctggactgctgaagcctagcgagacactgagcctgacctgtgctgtgtacggcggcagcttcagcggctactactggtcctggatcagacagcctcctggcaaaggactggaatggatcggcgagatcaaccacagcggctccaccaactacaaccccagcctgaagtccagagtgaccatcagcgtggacaccagcaagaaccagttctccctgaagctgagcagcgtgacagccgctgataccgccgtgtactattgcgctagagcccctcagtcttggtacgtgggagatgtgtggggccagggcacactggttacagtgtcatct

SEQ ID NO: 790 - DNA, 741 bp, Artificial Sequence
  Synthetic Polynucleotide
cagtctgtgctgacacagcctcctagcctgtctgtggcccctggaaagacagccagcatcacatgcggcggcaacaacatcggcatgaagtccgtgcactggtatcagcagaggccaggacaggctcctgtgctggtcatctactacgacagcgacagaccctctggcatccccggcagattttccggcagcaactctggcaataccgccacactgaccatctccagagtggaagctggcgacgaggccgactactactgccaagtgtgggataccaccggcgatcaccctggctatgtgtttggcaccggcaccaaagtgacagtgcttggcggaggcggaagtggaggcggaggatctggcggcggaggctctcaagttcaactggttcagagcggagccgaagtgaagaaacctggcagcagcgtgaaggtgtcctgcaaagcaagcggcggcacctttagcagctacgccatctcttgggtccgacaggcacctggacaaggactggaatggatgggcggcatcatccccatcttcggcacagccaattacgcccagaaattccagggcagagtgaccatcaccgccgacgagtctacaagcaccgcctacatggaactgagcagcctgagaagcgaggacaccgccgtgtactattgtgccagaggcgtgtacggctacagcggctctgccccttatgatgagtggggccagggaaccctggtcaccgtttcttct

SEQ ID NO: 791 - DNA, 756 bp, Artificial Sequence
  Synthetic Polynucleotide
gagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcggggcggaggcggaagtggaggcggaggatctggcggcggaggctctcaggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatct

SEQ ID NO: 792 - DNA, 738 bp, Artificial Sequence
  Synthetic Polynucleotide
gagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagagaggcggaggcggaagtggaggcggaggatctggcggcggaggctctgaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctct

SEQ ID NO: 793 - DNA, 690 bp, Artificial Sequence
  Synthetic Polynucleotide
gacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagc

SEQ ID NO: 794 - DNA, 720 bp, Artificial Sequence
  Synthetic Polynucleotide
gacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctct

SEQ ID NO: 795 - DNA, 732 bp, Artificial Sequence
  Synthetic Polynucleotide
gacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatct

SEQ ID NO: 796 - DNA, 750 bp, Artificial Sequence
  Synthetic Polynucleotide
gacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagggcggaggcggaagtggaggcggaggatctggcggcggaggctctcagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctct

SEQ ID NO: 797 - DNA, 720 bp, Artificial Sequence
  Synthetic Polynucleotide
gacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctct

SEQ ID NO: 798 - DNA, 723 bp, Artificial Sequence
  Synthetic Polynucleotide
gacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatct

SEQ ID NO: 799 - DNA, 735 bp, Artificial Sequence
  Synthetic Polynucleotide
gacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagt

SEQ ID NO: 800 - DNA, 720 bp, Artificial Sequence
  Synthetic Polynucleotide
gacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctct

SEQ ID NO: 801 - DNA, 723 bp, Artificial Sequence
  Synthetic Polynucleotide
gacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagcc

SEQ ID NO: 802 - DNA, 747 bp, Artificial Sequence
  Synthetic Polynucleotide
gacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctca

SEQ ID NO: 803 - DNA, 732 bp, Artificial Sequence
  Synthetic Polynucleotide
gacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttca

SEQ ID NO: 804 - DNA, 753 bp, Artificial Sequence
  Synthetic Polynucleotide
gaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaagggcggaggcggaagtggaggcggaggatctggcggcggaggctctgaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagt

SEQ ID NO: 805 - DNA, 744 bp, Artificial Sequence
  Synthetic Polynucleotide
gaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaagggcggaggcggaagtggaggcggaggatctggcggcggaggctctcaactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagt

SEQ ID NO: 806 - DNA, 726 bp, Artificial Sequence
  Synthetic Polynucleotide
gacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctct

SEQ ID NO: 807 - DNA, 726 bp, Artificial Sequence
  Synthetic Polynucleotide
gaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctct

SEQ ID NO: 808 - DNA, 720 bp, Artificial Sequence
  Synthetic Polynucleotide
gacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagc

SEQ ID NO: 809 - DNA, 720 bp, Artificial Sequence
  Synthetic Polynucleotide
gatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaac

SEQ ID NO: 810 - DNA, 723 bp, Artificial Sequence
  Synthetic Polynucleotide
gacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctct

SEQ ID NO: 811 - DNA, 726 bp, Artificial Sequence
  Synthetic Polynucleotide
gacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaaggcggaggcggaagtggaggcggaggatctggcggcggaggctctcaggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgca

SEQ ID NO: 812 - DNA, 723 bp, Artificial Sequence
  Synthetic Polynucleotide
gacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaagggcggaggcggaagtggaggcggaggatctggcggcggaggctctgaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagt

SEQ ID NO: 813 - DNA, 732 bp, Artificial Sequence
  Synthetic Polynucleotide
gaccaggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagcggcggaggcggaagtggaggcggaggatctggcggcggaggctcttcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgca

SEQ ID NO: 814 - DNA, 735 bp, Artificial Sequence
  Synthetic Polynucleotide
gacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaaggcggaggcggaagtggaggcggaggatctggcggcggaggctctcaggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatct

SEQ ID NO: 815 - DNA, 732 bp, Artificial Sequence
  Synthetic Polynucleotide
gagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatct

SEQ ID NO: 816 - DNA, 741 bp, Artificial Sequence
  Synthetic Polynucleotide
gagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagc

SEQ ID NO: 817 - DNA, 750 bp, Artificial Sequence
  Synthetic Polynucleotide
gacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagt

SEQ ID NO: 818 - DNA, 747 bp, Artificial Sequence
  Synthetic Polynucleotide
gacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagt

SEQ ID NO: 819 - DNA, 717 bp, Artificial Sequence
  Synthetic Polynucleotide
gagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagc

SEQ ID NO: 820 - DNA, 723 bp, Artificial Sequence
  Synthetic Polynucleotide
gacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctct

SEQ ID NO: 821 - DNA, 735 bp, Artificial Sequence
  Synthetic Polynucleotide
gaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctttcgaagtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatct

SEQ ID NO: 822 - DNA, 732 bp, Artificial Sequence
  Synthetic Polynucleotide
gaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctgaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatct

SEQ ID NO: 823 - DNA, 723 bp, Artificial Sequence
  Synthetic Polynucleotide
gacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatct

SEQ ID NO: 824 - DNA, 726 bp, Artificial Sequence
  Synthetic Polynucleotide
gccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagt

SEQ ID NO: 825 - DNA, 720 bp, Artificial Sequence
  Synthetic Polynucleotide
gacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttct

SEQ ID NO: 826 - DNA, 774 bp, Artificial Sequence
  Synthetic Polynucleotide
gacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagt

SEQ ID NO: 827 - DNA, 765 bp, Artificial Sequence
  Synthetic Polynucleotide
cagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatct

SEQ ID NO: 828 - DNA, 690 bp, Artificial Sequence
  Synthetic Polynucleotide
gacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttct

SEQ ID NO: 829 - DNA, 735 bp, Artificial Sequence
  Synthetic Polynucleotide
gacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatct

SEQ ID NO: 830 - DNA, 711 bp, Artificial Sequence
  Synthetic Polynucleotide
gacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagt

SEQ ID NO: 831 - DNA, 714 bp, Artificial Sequence
  Synthetic Polynucleotide
gacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatct

SEQ ID NO: 832 - DNA, 714 bp, Artificial Sequence
  Synthetic Polynucleotide
gacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgct

SEQ ID NO: 833 - DNA, 723 bp, Artificial Sequence
  Synthetic Polynucleotide
gacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaaggcggaggcggaagtggaggcggaggatctggcggcggaggctctgaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatct

SEQ ID NO: 834 - DNA, 729 bp, Artificial Sequence
  Synthetic Polynucleotide
gacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaaggcggaggcggaagtggaggcggaggatctggcggcggaggctctgaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagt

SEQ ID NO: 835 - DNA, 822 bp, Artificial Sequence
  Synthetic Polynucleotide
gacgaattccaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggaggaggcggctccgggggaggcggaagtggaggcggaggatctgggtctggaggaagcggatctggaggctcagggtcagggggctcaggcagtggaggcagcttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctct

SEQ ID NO: 836 - DNA, 747 bp, Artificial Sequence
  Synthetic Polynucleotide
gagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagt

SEQ ID NO: 837 - DNA, 735 bp, Artificial Sequence
  Synthetic Polynucleotide
cagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagt

SEQ ID NO: 838 - DNA, 720 bp, Artificial Sequence
  Synthetic Polynucleotide
gagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttct

SEQ ID NO: 839 - DNA, 729 bp, Artificial Sequence
  Synthetic Polynucleotide
gacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatct

SEQ ID NO: 840 - DNA, 756 bp, Artificial Sequence
  Synthetic Polynucleotide
gacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctct

SEQ ID NO: 841 - DNA, 729 bp, Artificial Sequence
  Synthetic Polynucleotide
agctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctct

SEQ ID NO: 842 - DNA, 738 bp, Artificial Sequence
  Synthetic Polynucleotide
aacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctct

SEQ ID NO: 843 - DNA, 726 bp, Artificial Sequence
  Synthetic Polynucleotide
gacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgct

SEQ ID NO: 844 - DNA, 726 bp, Artificial Sequence
  Synthetic Polynucleotide
gacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaagaggcggaggcggaagtggaggcggaggatctggcggcggaggctctcaggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctct

SEQ ID NO: 845 - DNA, 741 bp, Artificial Sequence
  Synthetic Polynucleotide
gagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagagaggcggaggcggaagtggaggcggaggatctggcggcggaggctctcaggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctcc

SEQ ID NO: 846 - DNA, 720 bp, Artificial Sequence
  Synthetic Polynucleotide
gacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctct

SEQ ID NO: 847 - DNA, 729 bp, Artificial Sequence
  Synthetic Polynucleotide
gagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctct

SEQ ID NO: 848 - DNA, 756 bp, Artificial Sequence
  Synthetic Polynucleotide
gacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctct

SEQ ID NO: 849 - DNA, 726 bp, Artificial Sequence
  Synthetic Polynucleotide
gagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatct

SEQ ID NO: 850 - DNA, 717 bp, Artificial Sequence
  Synthetic Polynucleotide
gacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagt

SEQ ID NO: 851 - DNA, 732 bp, Artificial Sequence
  Synthetic Polynucleotide
gacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagc

SEQ ID NO: 852 - DNA, 729 bp, Artificial Sequence
  Synthetic Polynucleotide
gacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatct

SEQ ID NO: 853 - DNA, 735 bp, Artificial Sequence
  Synthetic Polynucleotide
gacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctct

SEQ ID NO: 854 - DNA, 723 bp, Artificial Sequence
  Synthetic Polynucleotide
cagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctct

SEQ ID NO: 855 - DNA, 717 bp, Artificial Sequence
  Synthetic Polynucleotide
gacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctct

SEQ ID NO: 856 - DNA, 750 bp, Artificial Sequence
  Synthetic Polynucleotide
gccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagt

SEQ ID NO: 857 - DNA, 735 bp, Artificial Sequence
  Synthetic Polynucleotide
gacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagc

SEQ ID NO: 858 - DNA, 747 bp, Artificial Sequence
  Synthetic Polynucleotide
gagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcggggcggaggcggaagtggaggcggaggatctggcggcggaggctctgaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagt

SEQ ID NO: 859 - DNA, 741 bp, Artificial Sequence
  Synthetic Polynucleotide
gacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcggggcggaggcggaagtggaggcggaggatctggcggcggaggctctcaactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagt

SEQ ID NO: 860 - DNA, 753 bp, Artificial Sequence
  Synthetic Polynucleotide
gacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagagaggcggaggcggaagtggaggcggaggatctggcggcggaggctctgaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagt

SEQ ID NO: 861 - DNA, 735 bp, Artificial Sequence
  Synthetic Polynucleotide
gagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagt

SEQ ID NO: 862 - DNA, 735 bp, Artificial Sequence
  Synthetic Polynucleotide
cagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtggcggaggcggaagtggaggcggaggatctggcggcggaggctctcaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatct

SEQ ID NO: 863 - DNA, 735 bp, Artificial Sequence
  Synthetic Polynucleotide
cagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctct

SEQ ID NO: 864 - DNA, 738 bp, Artificial Sequence
  Synthetic Polynucleotide
caggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagc

SEQ ID NO: 865 - DNA, 720 bp, Artificial Sequence
  Synthetic Polynucleotide
gacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagt

SEQ ID NO: 866 - DNA, 726 bp, Artificial Sequence
  Synthetic Polynucleotide
gagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagt

SEQ ID NO: 867 - DNA, 723 bp, Artificial Sequence
  Synthetic Polynucleotide
gagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctct

SEQ ID NO: 868 - DNA, 729 bp, Artificial Sequence
  Synthetic Polynucleotide
gacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttct

SEQ ID NO: 869 - DNA, 702 bp, Artificial Sequence
  Synthetic Polynucleotide
gacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatct

SEQ ID NO: 870 - DNA, 711 bp, Artificial Sequence
  Synthetic Polynucleotide
gacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatct

SEQ ID NO: 871 - DNA, 732 bp, Artificial Sequence
  Synthetic Polynucleotide
gacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttct

SEQ ID NO: 872 - DNA, 744 bp, Artificial Sequence
  Synthetic Polynucleotide
gacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagagaggcggaggcggaagtggaggcggaggatctggcggcggaggctctgaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttct

SEQ ID NO: 873 - DNA, 720 bp, Artificial Sequence
  Synthetic Polynucleotide
gacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatct

SEQ ID NO: 874 - DNA, 723 bp, Artificial Sequence
  Synthetic Polynucleotide
gagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttct

SEQ ID NO: 875 - DNA, 726 bp, Artificial Sequence
  Synthetic Polynucleotide
gagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctct

SEQ ID NO: 876 - DNA, 741 bp, Artificial Sequence
  Synthetic Polynucleotide
gacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagaggcggaggcggaagtggaggcggaggatctggcggcggaggctctcaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagt

SEQ ID NO: 877 - DNA, 732 bp, Artificial Sequence
  Synthetic Polynucleotide
caggttcagctccagcagtctgatgccgagctggtcaagcctggcagcagcgtgaagattagctgcaaggccagcggctacaccttcaccgatcacgccatccactgggtcaagcagaagcctgagcagggcctcgaatggatcggccactttagccctggcaacaccgacatcaagtacaacgacaagttcaagggcaaagccacactgaccgtggacagaagcagcagcacagcctacatgcagctgaacagcctgaccagcgaggacagcgccgtgtacttctgcaagaccagcaccttctttttcgactactggggccagggcacaaccctgacagtttcttctggcggaggcggaagtggaggcggaggatctggcggcggaggctctgaactggttatgacacagagccccagcagcctgacagtgacagccggcgagaaagtgaccatgatctgcaagtctagccagagcctgctgaactccggcgatcagaagaactacctgacctggtatcagcagaaacccggccagcctcctaagctgctgatcttctgggccagcaccagagaaagcggcgtgcccgatagattcacaggcagcggcagcggaaccgacttcaccctgacaatcagctctgtgcaggccgaggacctggccgtgtattactgccagaacgactacagctaccctctgacctttggagccggcaccaagctggaactgaag

SEQ ID NO: 878 - DNA, 759 bp, Artificial Sequence
  Synthetic Polynucleotide
gacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggaggcggtggaagtggcggcggtggttcaggcggcggaggatctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttct

SEQ ID NO: 879 - DNA, 747 bp, Artificial Sequence
  Synthetic Polynucleotide
gagatcgtgctgacacagtctcccgccacactgtcactgtctccaggcgaaagagccacactgagctgtagagccagccagagcgtgtccatctacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcctcctttcacattcggccctggcaccaaggtggacatcaaaggcggaggcggaagtggaggcggaggatctggcggcggaggctctcaggtgcagcttgttgaaagcggaggcggagttgtgcagcctggcagaagtctgagactgtcttgtgccgccagcggcttcaccttcagcagctatggaatgcactgggtccgacaggcccctggcaaaggacttgaatgggttgccgtgatctgggacgacggcagcaacaagtattacgtggacagcgtgaagggcagattcaccatcagccgggacaacagcaagaacaccctgtacctccagatgaacagcctgagagccgaggacacagccgtgtattattgcgccagagatgactactacggcagcggctccttcaacagctactatggcacagacgtgtggggccagggcacaacagttaccgttagctct

SEQ ID NO: 880 - DNA, 702 bp, Artificial Sequence
  Synthetic Polynucleotide
gacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctgaagtgcaactggttcaatctggcggcggactggttcatccaggcggttctctgagactgagctgtgccggctctggcttcaccttcagcacctacctgatgtactgggtccgacaggcccctggcaagacactggaatgggtgtccgctattggcagcggaggcgatacctactacgccgactctgtgaagggcagattcaccatcagccgggacaacgccaagaacagcctgtacctccagatgaactccctgagagccgaggacatggccgtgtactactgtgccagaggactcggctattggggccagggaacactggtcacagtgtcctct

SEQ ID NO: 881 - DNA, 759 bp, Artificial Sequence
  Synthetic Polynucleotide
ctgcctgttctgacacagcctccatccgtgtctgtggcccctggaaagaccgccagaatcacatgcggcggcaacaacatcggcagcaagagcgtgcactggtatcagcagaagcctggacaggctcctgtgctggtggtgtacgacgacagcgatagacctagcggcatccccgagagattcagcggcagcaattccggcaataccgccacactgaccatcagcagagtggaagctggcgacgaggccgactactactgccaagtgtgggacagcagcagcgactacgtggtgtttggcggcggaacaaagctgacagtgcttggcggaggcggaagtggaggcggaggatctggcggcggaggctctgaagttcaactggtgcagagcggagccgaagtgaagaagccaggcgagagcctgaagattagctgcaaaggcagcggctacagcttcaccagctactggatcggctgggtccgacagatgcctggcaaaggactggaatggatgggcatcatctaccccggcgacagcgacaccagatacagccctagctttcagggccaagtgaccatctccgccgacaagagcatcagcacagcctacctccagtggtcctctctgaaggccagcgataccgccatgtactactgcgccagacaagtctggggatggcaaggcggcatgtaccccaggtctaactggtggtacaacctggactcttggggccagggcacactggtcacagtctcttct

SEQ ID NO: 882 - DNA, 729 bp, Artificial Sequence
  Synthetic Polynucleotide
cagtctgtgctgacacagcctcctagtgtgtctggcgctcctggacagagagtgaccatcagctgtacaggcagcagcagcaatatcggagccggctatgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctctgtgtttggcacaggcacaaaggtgctggtgcttggcggaggcggaagtggaggcggaggatctggcggcggaggctctcaagttcagctggttcagagcggagccgaagtgaagaaacctggcagcagcgtgaaggtgtcctgcaaagcaagcggcggcaccttcagcagctacaccatcaacgtttggagacaggccccaggccagggccttgaatggatgggaggcttcatccctatcagcggcaccgtgaactacgcccagaaattccagggcagagtgacaatcaccgccgacgagagcacaagcaccgcctacatggaactgtccagcctgagaagcgaggacaccgccgtgtactactgtgccagacctctggattggaccgaggacatctggggccagggaacactggtcacagtgtctagt

SEQ ID NO: 883 - DNA, 738 bp, Artificial Sequence
  Synthetic Polynucleotide
aacttcatgctgacccagcctcacagcgtgtccgagtctccaggcaagaccgtgaccatcagctgtacaggcagcagcggctctatcgccagcaactacgtgcagtggtatcagcagaggccaggcagcgcccctaccatcctgatctacgaggataacaagcggcctagcggcgtgcccgatagattttctggcagcatcgacagcagcagcaacagcgccagcctgacaatcagcggcctgaaaacaggcgacgaggccgactactactgccagagctacgacgacatcaaccactgggttttcggcggaggcaccaagctgacagttcttggaggcggaggcggaagtggaggcggaggatctggcggcggaggctctgaagttcagctggttcagagcggagccgaagtgaagaaacctggggcctctgtgaaggtgtcctgcaaggcttccggctacacctttaccgcctactacctgcactggctgagacaggctccaggccaaggactggaatggatgggctggatgaacaccaacaacggggccaccagatacgcccagaaattccaggacagagtgaccatgaccagagacaccagcatcaacaccgcctacatggaaatgagcggcctgtcctccgacgacaccgccatgtactattgtgccagaggcgacatcagccaggacttcgctgatgtgtggggccagggaacactggtcacagtgtcatct

SEQ ID NO: 884 - DNA, 714 bp, Artificial Sequence
  Synthetic Polynucleotide
cagatcgtgctgacacagagccctgccatcatgtccgcttctcccggcgagaaagtgaccatcacatgtagcgccagcagcagcgtgtcctacatgcactggttccagcagaagcccggcacaagccctaagctgtggatctacagcaccagcaatctggcctctggcgtgccagccagattttctggctctggcagcggcaccagctacagcctgacaatcagcagaatggaagccgaggacgccgccacctactactgtcagcagagaagcagctaccctcctacctttggcggaggcaccaagctggaaatcaaaggcggaggcggaagtggaggcggaggatctggcggcggaggctctcaggttcagctccagcagagcggagccgagcttatgaagcctggcgcttccgtgaagatcagctgcaaggccaccggctacaccttcagcagctactggatcgagtgggtcaagcagaggcccggacatggcctggaatggatcggagagatcctgcctggaagcggcagcaccaactacaacgagaagttcaagggcaaagccaccttcaccgccgacaccagcagcaacacagcctatatgcagctgagcagcctgaccagcgaggacagcgccgtgtactactgcgccagatacgactacccttggtttgcctattggggccagggcaccctggttacagtttctgct

SEQ ID NO: 885 - DNA, 738 bp, Artificial Sequence
  Synthetic Polynucleotide
gacatcgtgatgacacagagccctagcagcctgacagtgacagccggcgagaaagtgaccatgagctgcaagagcagccagagcctgctgaacagcggcaaccagaagaactacctgacctggtatcagcagaagcccggccagcctcctaagctgctgatctactgggccagcaccagagaaagcggcgtgcccgatagattcacaggcagcggcagcggaaccgacttcaccctgacaatcagctctgtgcaggccgaggatctggccgtgtactactgccagaacgactacagctaccccttcacctttggctccggcaccaagctggaaatcaaaggcggaggcggaagtggaggcggaggatctggcggcggaggctctcaagttcagctgcaacagcctggggccgaactcgttagacctggcgcttctgtgaagctgtcctgcaaggccagcggctacacctttaccagctactggatcaactgggtcaagcagcggcctggacagggcctcgaatggatcggcaatatctaccccagcgacagctacaccaactacaatcagaagttcaaggacaaggccacactgaccgtggacaagtctagcagcaccgcctacatgcagctgagcagccctacaagcgaggacagcgccgtgtattattgcacccggtcttggcggggcaacagcttcgattattggggccagggcacaaccctgaccgtgtcatct

SEQ ID NO: 886 - DNA, 732 bp, Artificial Sequence
  Synthetic Polynucleotide
gacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagt

SEQ ID NO: 887 - DNA, 747 bp, Artificial Sequence
  Synthetic Polynucleotide
gacatcgtgatgacacagagccctagcagcctggctatgagcgtgggccagaaagtgaccatgacctgcaagagcagccagagcctgctgaacagcagcaaccagaagaactacctggcctggtatcagcagaagcccggacagtctcctaagctgctggtgtactttgccagcaccagagaaagcggcgtgcccgacagattcatcggctctggaagcggcaccgacttcaccctgacaatcagctctgtgcaggccgaggacctggccgattacttctgtcaccagcactacagcacccctctgacctttggagccggcaccaagctggaactgaaaggcggaggcggaagtggaggcggaggatctggcggcggaggctctgaagttcagctccagcagagcggccctgaccttgtgaaacctggcgcttccgtgaagatgagctgcaaggccagcggctacaccttcaccagctacgtgatgcactgggtcaagcagaaacccggccagggccttgagtggatcggctacatctacccctacaacgatggcaccaagtacaacgagaagttcaagggcaaagccacactgaccagcgacaagtctagcagcaccgcctacatggaactgagcagcctgacctctgaggacagcgccgtgtactactgcgccagagaggaatacggcaactacgtgcggtacttcgacgtgtggggagccggaacaaccgtgacagtctcttct

SEQ ID NO: 888 - DNA, 729 bp, Artificial Sequence
  Synthetic Polynucleotide
cagtctgtggtcacacagcctccatccgtgtctgctgcccctggacagaaagtgaccatcagctgtagcggcagcagcagcaacatcggcaacaactacgtgtcctggtatcagcagctgcccggcacagctcccaaactgctgatctacgacaacaacaagcggcccagcggcatccccgatagattttctgccagcaagagcggcaccagcgccacactgggaatcacaggactccagaccagagatgaggccgactactactgcggcacctgggattcttctctgtccgcctgggttttcggcggaggcacaaaactgacagtgctcggaggcggaggcggaagtggaggcggaggatctggcggcggaggctctcaagttcagctggttcagtctggggccgaagtgaagaaacctggcagcagcgtgaaggtgtcctgcaaggcttccggcgataccttcagcagctactacatcagctgggtccgacaggccccaggacaaggacttgagtggatgggcagaatcatccccatcctgggaatcgccaactacgcccagaaataccagggcagagtgaccctgagcgccgacaagagcacaagcaccagctacatggaactgaacagcctgagcagcgaggacaccgccgtgtactattgtgccctggactggtcctacagcatcgactattggggccagggcaccctggtcacagtctcttct

SEQ ID NO: 889 - DNA, 741 bp, Artificial Sequence
  Synthetic Polynucleotide
gaagtgaagctggtggaatctggcggcggactggttaagtttggcggcagcctgaagctgagctgtgccgcctctggctttaccctgagcagctactacatgagctgggtccgacagagccccgagaagagactggaactggtggccgtgattaacagcaacggcggcagcacctactatcccgacacagtgaagggcagattcaccatcagccgggacaacgccaagaacaccctgtacctccagatgtctagcctgaagtccgaggacacagccctgtactactgcgccagaccattctactacagcaacagccccttcgcctattggggccagggaacactggttacagtgtctgctggcggaggcggaagtggaggcggaggatctggcggcggaggctctgatgttctgatgacccagacacctctgagcctgcctgtgtctctgggcgatcaggccagcatctcctgtagaagcagccagagcatcgtgcacagaaccggcaacacctacctggaatggtatctccagaagcctgggcagagccccaagctgctgatctacaaggtgtccaacagattcagcggcgtgcccgacagattttctggcagcggctctggcaccgacttcaccctgaagattagcagagtgggagccgaggacctgggcgtctactactgctttcaaggcagccacgtgccatacacctttggcggaggcaccaagctggaaatcaag

SEQ ID NO: 890 - DNA, 738 bp, Artificial Sequence
  Synthetic Polynucleotide
gagctggtcatgacacagagccctgcttctctggccgtgtcactgggacagagagccaccatctcttgcagagccagcgagagcgtggacagctacggcaagagcttcatgcactggtatcagctcaagcccggccagcctcctaagctgctgatctacagagcctccaacctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaagctggaaatcaaaggcggaggcggaagtggaggcggaggatctggcggcggaggctctgaagtgcagctcgaacagtctggccccgagcttgtgaaacctggcgcttccgtgaagatgagctgcaaggccagcggctacaccttcaccaactactacatgaaatgggtcaagcagagccacggcaagtccctggaatggatcggcgatctgaaccccaacaacggcgacaccttctacaaccagaagttcaagggcaaagccacactgaccgtggacaagagcagcaacaccgcctacatgcagctcaactccctgaccagcgaggacagcgccgtgtactactgtgccagaaccggcagatacgaagagaacgctatggactactggggccagggcacaagcgtgacagtctcttct

SEQ ID NO: 891 - DNA, 720 bp, Artificial Sequence
  Synthetic Polynucleotide
gacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttct

SEQ ID NO: 892 - DNA, 741 bp, Artificial Sequence
  Synthetic Polynucleotide
gacgtgctgatgacccagacacctgtgtctctgtccgtgtctctgggagatcaggccagcatctcctgtagaagcagccagagcatcgtgcacagcaccggcaacacctacctggaatggtatctccagaagcctggacagagccccaagctgctgatctacaagatcagcaacagattcagcggcgtgcccgacagattttctggcagcggctctggcaccgacttcaccctgaagattagcagagtggaagccgaggacctgggcgtgtactactgcttccaagcctctcacgcccctagaacctttggcggaggcaccaagctggaaatcaagagaggcggaggcggaagtggaggcggaggatctggcggcggaggctctgaagtgatcctggtggaaagcggaggcggccttgtgaaacctggcggatctctgaagctgagctgtgccgccagcggcttcacctttagcagctacacaatgagctgggtccgacagacccctgagaagagactggaatgggtcgccaccatctcttccggcggagggaacacctactatcccgactctgtgaagggcagattcaccatcagccgggacaacgccaagaacaacctgtacctccagatgagcagcctgcggagcgaagatacagccctgtactattgcgcccggtactacagatacgaggcttggtttgcctcttggggccagggcacactggttacagtttctgct

SEQ ID NO: 893 - DNA, 735 bp, Artificial Sequence
  Synthetic Polynucleotide
gaggtgcaactggttgagtctggcggaggactggtgcagcctggaagaagcctgagactgtcttgtgccgccagcggcttcaccttcgacgattatgccatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactactgcgccaaagacaaaggcggaggctactacgacttttggagcggcagcgattattggggccagggcacactggtcacagtgtctagcggcggaggcggaagtggaggcggaggatctggcggcggaggctcttcttctgagctgacacaggaccctgccgtgtctgttgctctgggccagacagtgcggattacctgtcagggcgatagcctgagaagctactacgcctcctggtatcagcagaagccaggccaggctcctgtgctggtcatctacggcaagaacaacagacccagcggcatccccgatagattcagcggaagcagctctggcaataccgccagcctgacaattactggcgctcaggccgaggacgaggccgactactactgcaacagcagagatagcagcggctgggttttcggcggaggcacaaaactgacagtgctg

SEQ ID NO: 894 - DNA, 762 bp, Artificial Sequence
  Synthetic Polynucleotide
gaagtgcagctccagcagtctggacctggcctggttaagcctagccagacactgagcctgacctgtgccatcagcggcgatagcgtgctgagcaacagcgacacctggaactggatcagacagagccctagcagaggactggaatggctgggcagaacctaccacagaagcacttggtacgacgactacgccagctctgtgcggggcagagtgtccatcaatgtggacaccagcaagaaccagtacagcctgcaactgaacgccgtgacacctgaggataccggcgtgtactactgcgccagagacagactccaggacggcaactcttggagcgacgcctttgatgtgtggggccagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactggtgtacgtgttcggcacaggcaccaaagtgaccgtgctt

SEQ ID NO: 895 - DNA, 756 bp, Artificial Sequence
  Synthetic Polynucleotide
caggtgcaactggttcagtctggggccgaagtgaagaaacctggggcctctgtgaaggtgtcctgcaaggcttccggctacacctttaccagctacgacatcaactgggtccgacaggccacaggccaaggactggaatggatgggctggatgaaccccaacagcggcaataccggctacgcccagaaattccagggcagagtgaccatgaccagaaacaccagcatcagcaccgcctacatggaactgagcagcctgagaagcgaggacaccgccgtgtactattgcgccagaggcgacagcaactactggtcctactacggcatggacgtgtggggccagggaacactggttacagtttctagcggcggaggcggaagtggaggcggaggatctggcggcggaggctctggcggtggtggatctcaatctgtgctgacccagcctagatccgtgtctggctctcctggacagagcgtgaccatctcttgtaccggcaccagctctgatgtcggcggctacaattacgtgtcctggtatcagcagcaccccggcgaagcccctaagctgattatctacgacgccgacaagcggcccagcggcatcagcaatagattcagctctggcaagagcggcaacaccgccagcctgacaatcagcggactccaggtggaagatgaggccgactactactgctgctcctatgccggcggaagcacctgggttttcggaggcggtacaaaagtgaccgtgctg

SEQ ID NO: 896 - DNA, 762 bp, Artificial Sequence
  Synthetic Polynucleotide
gaagtgcagctccagcagtctggacctggcctggttaagcctagccagacactgagcctgacctgtgccatcagcggcgatagcgtgtcctctaatagcgccgcctggaactggatcagacagagccctagcagaggactggaatggctgggcagaacctactaccgcagcaagtggtacagcgactacgccgtgtccgtgaagtcccggatcaccatcaatcccgacaccagcaagaaccagttcagcctgcaactgaacagcgtgacccctgaggataccgccgtgtactactgcgccagagatccctacgacttttggagcggctaccccgacgcctttgacatctggggacagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaaagtgattatcagcgaagtgaacaacagacccagcggcgtgtcccacagattcagcggctctaagtctggcaacaccgccagcctgacaatctctggactgcaagccgaggacgaggccgactacttctgtagcagctacaccagcggcagaaccctgtacgtgttcggcacaggcagcaaagtgacagtgctggga

SEQ ID NO: 897 - DNA, 759 bp, Artificial Sequence
  Synthetic Polynucleotide
gaagtgcagctccagcagtctggacctggcctggttaagcctagccagacactgagcctgacctgtgccatcagcggcgattccatgctgagcaacagcgacacctggaactggatcagacagagccccagcagaggcctggaatggctgggcagaacataccacagaagcacttggtacgacgactacgccagctctgtgcggggcagagtgtccatcaatgtggacaccagcaagaaccagtacagcctgcaactgaacgccgtgacacctgaggataccggcgtgtactactgtgccagagtgcggctccaggacggcaattcttggagcgacgcctttgatgtgtggggccagggcacaatggtcaccgtttctagcggcggaggcggaagtggaggcggaggatctggcggcggaggctctcaatctgctctgacacagcctgccagcgcctctggatctcctggacagagcgtgaccatctcctgtaccggcacctcttctgatgtcggcggctacaactacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactgtacgtgttcggcacaggcacccagctcacagttctt

SEQ ID NO: 898 - DNA, 726 bp, Artificial Sequence
  Synthetic Polynucleotide
gacgtggtcatgacacagagcccttctagcctgtctgccagcgtgggcgacagagtgaccatcacatgtagagccagccaggacatcagcaagtacctgaactggtatcagcagaagcccggcaaggcccctaagctgctgatctaccacaccagcagactgcacagcggcgtgccaagcagattttctggcagcggctctggcaccgacttcaccctgacaatatccagcctccagcctgaggacttcgccacctactattgccagcagggcaacaccctgccttacacctttggcggcggaacaaaggtggaaatcaaaggcggaggcggaagtggaggcggaggatctggcggcggaggctctcaagttcagctgcaagagtctggccctggcctggtcaagcctagccaaacactgagcctgacctgtaccgtcagcggagtgtccctgcctgattatggcgtgtcctggatcagacagcctcctggcaaaggactggaatggatcggcgtgatctggggcagcgagacaacctactacaacagcgccctgaagtccagagtgctgatctccgtggacaccagcaagaaccaggtgtccctgaagctgagcagcgtgacagccgctgataccgccgtgtactactgcgccagacactactactacggcggcagctacgctatggactattggggccagggcaccaccgtgacagtctcttct

SEQ ID NO: 899 - DNA, 732 bp, Artificial Sequence
  Synthetic Polynucleotide
gagatcgtgctgacacagtctcccgccacactgtcactgtctccaggcgaaagagccacactgagctgtagcgccagcagcagcgtgtcctacatgtactggtatcagcagaagcccggacaggcccctagactgctgatctacagaaccagcaacctggcctctggcatccccgccagattttctggctctggcagcggcaccgatttcaccctgaccataagcagcctggaacctgaggacttcgccgtgtactactgccagcagtaccacagctaccccaccacctttggacagggcaccaaggtggaaatcaagcggacagttggcggaggcggaagtggaggcggaggatctggcggcggaggctctgaagtgcagctggttgaatcaggtggcggcctggttcaacctggcggatctctgagactgtcttgtgccgccagcggcttcagcttcaacacctacgccatgaactgggtccgacaggctcctggcaaaggactggaatgggtgtcccacatcagaagcaagagcaacaacttcgccacctactacgccgacagcgtgaaggacagattcaccatcagccgggacaacgccaagaacagcctgtacctccagatgaactccctgagagccgaggacaccgccgtgtattattgcgccagacaaggcggcgacttccctatggattattggggccagggcaccctggtcaccgtttcttct

SEQ ID NO: 900 - DNA, 720 bp, Artificial Sequence
  Synthetic Polynucleotide
gacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatct

SEQ ID NO: 901 - DNA, 735 bp, Artificial Sequence
  Synthetic Polynucleotide
gacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctct

SEQ ID NO: 902 - DNA, 729 bp, Artificial Sequence
  Synthetic Polynucleotide
gacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttct

SEQ ID NO: 903 - DNA, 30 bp, Artificial Sequence
  Synthetic Polynucleotide
gagcagaaactgatctcggaagaggatctg

SEQ ID NO: 904 - DNA, 24 bp, Artificial Sequence
  Synthetic Polynucleotide
gactacaaggacgacgatgacaag

SEQ ID NO: 905 - DNA, 25 bp, Artificial Sequence
  Synthetic Polynucleotide
gattataaagatgatgacgataaag

SEQ ID NO: 906 - DNA, 27 bp, Artificial Sequence
  Synthetic Polynucleotide
agttggaaggatgcctctggatggtcc

SEQ ID NO: 907 - DNA, 27 bp, Artificial Sequence
  Synthetic Polynucleotide
agttggaaggatgcctctggatggtct

SEQ ID NO: 908 - DNA, 42 bp, Artificial Sequence
  Synthetic Polynucleotide
gggaaaccaattcccaaccctcttctgggactggattcaacc

SEQ ID NO: 909 - DNA, 27 bp, Artificial Sequence
  Synthetic Polynucleotide
tacccctacgatgtgcccgattacgct

SEQ ID NO: 910 - DNA, 27 bp, Artificial Sequence
  Synthetic Polynucleotide
caccatcatcaccatcacggcagcggc

SEQ ID NO: 911 - DNA, 45 bp, Artificial Sequence
  Synthetic Polynucleotide
ggcctgaacgacatcttcgaggctcagaagatcgaatggcacgag

SEQ ID NO: 912 - DNA, 24 bp, Artificial Sequence
  Synthetic Polynucleotide
tggtctcatccccagtttgaaaag

SEQ ID NO: 913 - DNA, 24 bp, Artificial Sequence
  Synthetic Polynucleotide
tggtcccatccccagttcgagaaa

SEQ ID NO: 914 - DNA, 198 bp, Artificial Sequence
  Synthetic Polynucleotide
ggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcac

SEQ ID NO: 915 - DNA, 90 bp, Artificial Sequence
  Synthetic Polynucleotide
gactacaaggacgacgatgacaaggattataaagatgatgacgataaagtcgagaccgatttctacgactacaaggacgacgatgacaag

SEQ ID NO: 916 - DNA, 156 bp, Artificial Sequence
  Synthetic Polynucleotide
tacccctacgatgtgcccgattacgcttggagccaccctcagtttgaaaaatacccctatgacgtgccggactacgctggctatccttacgacgtcccagactacgcaggctacccctacgacgtcccagattaccaccatcaccaccaccatcat

SEQ ID NO: 917 - DNA, 51 bp, Artificial Sequence
  Synthetic Polynucleotide
atcaacatctacaacgccgagcctgccaatcctagcgagaagaacagcccc

SEQ ID NO: 918 - DNA, 78 bp, Artificial Sequence
  Synthetic Polynucleotide
tacatcaacatctacaacgccgagcctgccaatcctagcgagaagaacagccccacacagtacgcctacggcagcgga

SEQ ID NO: 919 - DNA, 69 bp, Artificial Sequence
  Synthetic Polynucleotide
tacatcaacatctacaacgccgagcctgccaatcctagcgagaagaacagccccagcacacagtacgcc

SEQ ID NO: 920 - DNA, 45 bp, Artificial Sequence
  Synthetic Polynucleotide
gccgagcccgccaaccccagcgagaagaacagccccggcggatct

SEQ ID NO: 921 - DNA, 504 bp, Artificial Sequence
  Synthetic Polynucleotide
aagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgac

SEQ ID NO: 922 - DNA, 510 bp, Artificial Sequence
  Synthetic Polynucleotide
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 923 - DNA, 441 bp, Artificial Sequence
  Synthetic Polynucleotide
gaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgac

SEQ ID NO: 924 - DNA, 456 bp, Artificial Sequence
  Synthetic Polynucleotide
aaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacaga

SEQ ID NO: 925 - DNA, 66 bp, Artificial Sequence
  Synthetic Polynucleotide
gtgaagcagaccctgaatttcgacctgctgaagctggctggcgacgtggaatccaacccaggccct

SEQ ID NO: 926 - DNA, 54 bp, Artificial Sequence
  Synthetic Polynucleotide
gagggcagaggaagtctactaacctgcggagatgtggaagaaaatcctggccca

SEQ ID NO: 927 - DNA, 54 bp, Artificial Sequence
  Synthetic Polynucleotide
gagggaagaggtagcctcctcacctgtggggacgttgaagagaaccccggccca

SEQ ID NO: 928 - DNA, 57 bp, Artificial Sequence
  Synthetic Polynucleotide
gcaacaaacttctcactactcaaacaagcaggtgacgtggaggagaatcccgggcct

SEQ ID NO: 929 - DNA, 57 bp, Artificial Sequence
  Synthetic Polynucleotide
gcaacaaacttctcactactcaaacaagcaggtgacgtggagcagaatcccgggcct

SEQ ID NO: 930 - DNA, 60 bp, Artificial Sequence
  Synthetic Polynucleotide
caatgcactaattacgcattgctcaagctggccggtgacgttgagagtaatcctggcccc

SEQ ID NO: 931 - DNA, 12 bp, Artificial Sequence
  Synthetic Polynucleotide
tctggatctgga

SEQ ID NO: 932 - DNA, 12 bp, Artificial Sequence
  Synthetic Polynucleotide
agcggatctggc

SEQ ID NO: 933 - DNA, 12 bp, Artificial Sequence
  Synthetic Polynucleotide
cgggccaagaga

SEQ ID NO: 934 - DNA, 12 bp, Artificial Sequence
  Synthetic Polynucleotide
agggccaagcga

SEQ ID NO: 935 - DNA, 12 bp, Artificial Sequence
  Synthetic Polynucleotide
cgcgccaagaga

SEQ ID NO: 936 - DNA, 216 bp, Artificial Sequence
  Synthetic Polynucleotide
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgc

SEQ ID NO: 937 - DNA, 678 bp, Artificial Sequence
  Synthetic Polynucleotide
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 938 - DNA, 342 bp, Artificial Sequence
  Synthetic Polynucleotide
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 939 - DNA, 126 bp, Artificial Sequence
  Synthetic Polynucleotide
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 940 - DNA, 336 bp, Artificial Sequence
  Synthetic Polynucleotide
agagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 941 - DNA, 336 bp, Artificial Sequence
  Synthetic Polynucleotide
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 942 - DNA, 324 bp, Artificial Sequence
  Synthetic Polynucleotide
aaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccacgccgccccggacccacccgcaagcattaccagccctatgccccaccacgcgacttcgcagcctatcgctcc

SEQ ID NO: 943 - DNA, 501 bp, Artificial Sequence
  Synthetic Polynucleotide
aaagagagcagcggcggacccgacagccctgatacagagcctggaagctctgccggacctacccagaggcccagcgacaacagccacaatgaacacgcccctgccagccagggactgaaggccgagcacctgtacatcctgatcggcgtgtccgtggtgttcctgttctgcctgctgctgctggtgctgttctgtctgcaccggcagaaccagatcaagcagggacctcccagaagcaaggacgaggaacagaagcctcagcagaggcccgacctggccgtggacgtgctggaaagaacagccgacaaggccaccgtgaacggcctgcccgagaaggacagagagacagacacaagcgccctggccgctggcagctctcaggaagtgacatacgcccagctggaccactgggctctgacccagagaacagccagagccgtgtccccccagagcaccaaacctatggccgagagcatcacctacgccgccgtggctagacac

SEQ ID NO: 944 - DNA, 450 bp, Artificial Sequence
  Synthetic Polynucleotide
ttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaag

SEQ ID NO: 945 - DNA, 450 bp, Artificial Sequence
  Synthetic Polynucleotide
ttcaagattccaatcgaggaacttgaagatcgggtgtttgtgaactgcaatacgagcattacgtgggtagaagggacggtcggcacattgctttccgacatcactcgcttggacttgggtaaaaggatactcgatccacgaggaatttaccgatgcaacggaaccgacatatacaaggacaaagaatctacggttcaggttcactatcggatgtgtcagagctgcgttgaactcgatccggccaccgtcgccgggattatcgtgaccgacgtaattgctacactgctgcttgcacttggggtattctgtttcgcgggacacgagacggggagactctccggcgctgcggacacacaggcccttttgagaaacgatcaggtctaccaacctttgcgggatcgagacgatgcccaatactcccaccttggcgggaactgggccaggaataag

SEQ ID NO: 946 - DNA, 390 bp, Artificial Sequence
  Synthetic Polynucleotide
gacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtcc

SEQ ID NO: 947 - DNA, 165 bp, Artificial Sequence
  Synthetic Polynucleotide
aagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 948 - DNA, 555 bp, Artificial Sequence
  Synthetic Polynucleotide
gacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 949 - DNA, 480 bp, Artificial Sequence
  Synthetic Polynucleotide
cagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaac

SEQ ID NO: 950 - DNA, 480 bp, Artificial Sequence
  Synthetic Polynucleotide
cagtcaataaaagggaatcatttggtcaaagtttatgattatcaggaggatgggagtgtcctcttgacgtgtgacgcagaggcaaagaatatcacttggttcaaggacggaaaaatgataggctttcttaccgaagacaagaagaaatggaaccttgggtcaaatgctaaagatccccgagggatgtaccaatgtaaaggatcacaaaacaaaagtaaacccctccaggtatattatagaatgtgccagaactgcatcgagttgaatgcggccacaattagcggctttttgttcgctgaaatcgtctccatcttcgtcctcgcagtcggcgtctactttatcgcaggacaggacggggtccgacaaagccgcgcctccgacaagcaaacacttcttcccaacgaccagttgtatcaaccgctgaaagaccgggaagatgaccagtattcacatctccaaggcaatcagctccgcagaaac

SEQ ID NO: 951 - DNA, 390 bp, Artificial Sequence
  Synthetic Polynucleotide
gacggcaatgaggaaatgggcggcatcacccagacaccatacaaggtgtccatcagcggcaccaccgtgatcctgacctgtcctcagtatcccggcagcgagattctgtggcagcacaacgacaagaacatcggcggcgacgaggacgataagaatatcggctccgatgaggaccacctgagcctgaaagagttcagcgagctggaacagagcggctactacgtgtgctaccccagaggcagcaagcccgaggacgccaacttttacctgtacctgagagccagagtgtgcgagaactgcatggaaatggacgtgatgtccgtggctaccatcgtgatcgtggacatctgcatcaccggcggactgctgctgctggtgtactactggtcc

SEQ ID NO: 952 - DNA, 165 bp, Artificial Sequence
  Synthetic Polynucleotide
aagaaccggaaggccaaggccaagcctgtgacaagaggtgctggtgctggcggcagacagagaggccagaacaaagaaagacctcctcctgtgcctaatcctgactacgagcccatcagaaaaggccagcgggatctgtacagcggcctgaaccagagaagaatc

SEQ ID NO: 953 - DNA, 555 bp, Artificial Sequence
  Synthetic Polynucleotide
gacggcaatgaggaaatgggcggcatcacccagacaccatacaaggtgtccatcagcggcaccaccgtgatcctgacctgtcctcagtatcccggcagcgagattctgtggcagcacaacgacaagaacatcggcggcgacgaggacgataagaatatcggctccgatgaggaccacctgagcctgaaagagttcagcgagctggaacagagcggctactacgtgtgctaccccagaggcagcaagcccgaggacgccaacttttacctgtacctgagagccagagtgtgcgagaactgcatggaaatggacgtgatgtccgtggctaccatcgtgatcgtggacatctgcatcaccggcggactgctgctgctggtgtactactggtccaagaaccggaaggccaaggccaagcctgtgacaagaggtgctggtgctggcggcagacagagaggccagaacaaagaaagacctcctcctgtgcctaatcctgactacgagcccatcagaaaaggccagcgggatctgtacagcggcctgaaccagagaagaatc

SEQ ID NO: 954 - DNA, 90 bp, Artificial Sequence
  Synthetic Polynucleotide
cagagcttcggcctgctggaccccaagctgtgctacctgctggatggcatcctgttcatctacggcgtgatcctgaccgccctgttcctg

SEQ ID NO: 955 - DNA, 339 bp, Artificial Sequence
  Synthetic Polynucleotide
agagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaaga

SEQ ID NO: 956 - DNA, 90 bp, Artificial Sequence
  Synthetic Polynucleotide
cagagttttgggttgttggaccctaaattgtgctatctgttggacggaatcctgttcatttacggagtgatcctgaccgcattgttcctg

SEQ ID NO: 957 - DNA, 339 bp, Artificial Sequence
  Synthetic Polynucleotide
cgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 958 - DNA, 429 bp, Artificial Sequence
  Synthetic Polynucleotide
cagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 959 - DNA, 519 bp, Artificial Sequence
  Synthetic Polynucleotide
ggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 960 - DNA, 477 bp, Artificial Sequence
  Synthetic Polynucleotide
ggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 961 - DNA, 477 bp, Artificial Sequence
  Synthetic Polynucleotide
ggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 962 - DNA, 513 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 963 - DNA, 489 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 964 - DNA, 489 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 965 - DNA, 597 bp, Artificial Sequence
  Synthetic Polynucleotide
atgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 966 - DNA, 396 bp, Artificial Sequence
  Synthetic Polynucleotide
atggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggc

SEQ ID NO: 967 - DNA, 327 bp, Artificial Sequence
  Synthetic Polynucleotide
actagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaa

SEQ ID NO: 968 - DNA, 322 bp, Artificial Sequence
  Synthetic Polynucleotide
ggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcggga

SEQ ID NO: 969 - DNA, 651 bp, Artificial Sequence
  Synthetic Polynucleotide
atgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaa

SEQ ID NO: 970 - DNA, 1257 bp, Artificial Sequence
  Synthetic Polynucleotide
atggggagtagcaagagcaagcctaaggaccccagccagcgcggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaactagtgccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 971 - DNA, 42 bp, Artificial Sequence
  Synthetic Polynucleotide
atggggagtagcaagagcaagcctaaggaccccagccagcgc

SEQ ID NO: 972 - DNA, 564 bp, Artificial Sequence
  Synthetic Polynucleotide
atggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 973 - DNA, 903 bp, Artificial Sequence
  Synthetic Polynucleotide
atgactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 974 - DNA, 1224 bp, Artificial Sequence
  Synthetic Polynucleotide
atgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 975 - DNA, 1257 bp, Artificial Sequence; identical to SEQ ID NO: 970
  Synthetic Polynucleotide

SEQ ID NO: 976 - DNA, 1728 bp, Artificial Sequence
  Synthetic Polynucleotide
atgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatggcgcactttccgggctttggacagtcactcctgtacggctatcccgtctatgtattcggtgattgtgtgcaagccgattggtgtccagtgtccggtggtctgtgcagtacacggcttcaccggcacgccctgctggcaacttgccccgaacaccagcttacatgggacccaatcgacggtcgcgtagtgtcttctcccctccagtatctgattcctagattgccttcctttccaacacagaggaccagccggaccctgaaggttctgaccccaccgactacaccagtgtcccccaaagtgcctcccgccttcttccaaagtatgagaaaacatactccctataggaatggctgcttggagccaaccctcggtgaccaactcccctcactcgccttccccgaacctggcctgcgcccacagaacatctatactacttggggcaagactgtggtatgcctttacctgtaccagctgagtcccccgatgacatggcccctcatcccccacgtcattttctgtcacccacggcagctgggagcgttccttaccaaagttccgctcaaacgcctggaggaactgctgtataagatgtttctgcacactggtgccgtgatcgtgctgcccgaggacgatctgcccaccacaatgttccagccggtgcgggctccttgcatccagactgcttggtgcacaggccttctgccttaccactccatactcacaacccctggtctgatctggaccttcaatgacggaagccctatgatttcaggaccttgtcccaaggctggacagccatctctggttgtgcagtcatctctgctcatcttcgagaaattccaaaccaaggcctttcatccatcctacctcctctcccatcagctgatacagtacagctccttccacaacttgcacctgctctttgatgaatatacgaatattccagtcagcagaagcttcaacaagggcgaggccgatgataatggcgaccagccgcctgagcctgccgcacagggtgaaagctccacacagaaggtgcggccctcccatactaacaatccaaag

SEQ ID NO: 977 - DNA, 1749 bp, Artificial Sequence
  Synthetic Polynucleotide
atgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccgggcctacaaggacgacgatgacaaggcgcactttccgggctttggacagtcactcctgtacggctatcccgtctatgtattcggtgattgtgtgcaagccgattggtgtccagtgtccggtggtctgtgcagtacacggcttcaccggcacgccctgctggcaacttgccccgaacaccagcttacatgggacccaatcgacggtcgcgtagtgtcttctcccctccagtatctgattcctagattgccttcctttccaacacagaggaccagccggaccctgaaggttctgaccccaccgactacaccagtgtcccccaaagtgcctcccgccttcttccaaagtatgagaaaacatactccctataggaatggctgcttggagccaaccctcggtgaccaactcccctcactcgccttccccgaacctggcctgcgcccacagaacatctatactacttggggcaagactgtggtatgcctttacctgtaccagctgagtcccccgatgacatggcccctcatcccccacgtcattttctgtcacccacggcagctgggagcgttccttaccaaagttccgctcaaacgcctggaggaactgctgtataagatgtttctgcacactggtgccgtgatcgtgctgcccgaggacgatctgcccaccacaatgttccagccggtgcgggctccttgcatccagactgcttggtgcacaggccttctgccttaccactccatactcacaacccctggtctgatctggaccttcaatgacggaagccctatgatttcaggaccttgtcccaaggctggacagccatctctggttgtgcagtcatctctgctcatcttcgagaaattccaaaccaaggcctttcatccatcctacctcctctcccatcagctgatacagtacagctccttccacaacttgcacctgctctttgatgaatatacgaatattccagtcagcagaagcttcaacaagggcgaggccgatgataatggcgaccagccgcctgagcctgccgcacagggtgaaagctccacacagaaggtgcggccctcccatactaacaatccaaag

SEQ ID NO: 978 - DNA, 1257 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 979 - DNA, 1257 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 980 - DNA, 1257 bp, Artificial Sequence
  Synthetic Polynucleotide
atgaataggcacctctggaagagccaactgtgtgagatggtgcagcccagtggtggcccggcagcagttcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 981 - DNA, 753 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggc

SEQ ID NO: 982 - DNA, 753 bp, Artificial Sequence
  Synthetic Polynucleotide
atgaataggcacctctggaagagccaactgtgtgagatggtgcagcccagtggtggcccggcagcagttcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggc

SEQ ID NO: 983 - DNA, 825 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtg

SEQ ID NO: 984 - DNA, 825 bp, Artificial Sequence
  Synthetic Polynucleotide
atgaataggcacctctggaagagccaactgtgtgagatggtgcagcccagtggtggcccggcagcagttcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtg

SEQ ID NO: 985 - DNA, 1161 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagc

SEQ ID NO: 986 - DNA, 1161 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagc

SEQ ID NO: 987 - DNA, 1161 bp, Artificial Sequence
  Synthetic Polynucleotide
atgaataggcacctctggaagagccaactgtgtgagatggtgcagcccagtggtggcccggcagcagttcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagc

SEQ ID NO: 988 - DNA, 1014 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagg

SEQ ID NO: 989 - DNA, 1014 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagg

SEQ ID NO: 990 - DNA, 1014 bp, Artificial Sequence
  Synthetic Polynucleotide
atgaataggcacctctggaagagccaactgtgtgagatggtgcagcccagtggtggcccggcagcagttcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagg

SEQ ID NO: 991 - DNA, 1236 bp, Artificial Sequence
  Synthetic Polynucleotide
atgaacaagcacccctggaagaaccagctgagtgagacggtgcagcccagtggtggcccagcagaggaccaggacatgctgggtgaagaatcttctctggggaagcctgcaatgctacatctgccttcagagcagggtactcctgagaccctccagcgctgcctggaagagaatcaagagctccgagacgctatccggcagagcaatcagatgctgagggaacgctgtgaggagctgctgcatttccaggtcagccagcgggaggagaaggagttccttatgtgcaaattccaggaagcccggaagctggtggagagactgagcttggagaagcttgatcttcggagtcagagggaacaggccttaaaggagttggagcaactgaagaaatgccaacagcagatggctgaggacaaggcctctgtgaaagctcaggtgacatcattgctcggagaactccaggagagccagagccgtttggaggctgccaccaaggatcggcaagctttagagggaaggattcgagcagttagtgagcaggtcagacagctggagagtgagcgggaggtgctacagcagcagcacagcgtccaggtggaccagctgcgtatgcagaaccagagcgtggaggctgccttgcgaatggagcggcaggctgcttcagaggagaagcggaagctggctcagttgcaggcagcctatcaccaactcttccaagactacgacagccacattaagagcagcaagggcatgcagctggaagatctgaggcaacagctccagcaagctgaggaggccctggtagccaaacaggaattgattgataagctgaaagaggaggctgagcagcacaagattgtgatggagactgtgccagtcttgaaggcccaggcggatatctacaaggctgacttccaagctgagaggcatgcccgggagaagctggtggagaagaaggagtatttgcaggagcagctggagcagctgcagcgcgagttcaacaagctgaaagttggctgccatgagtcagccaggattgaggatatgaggaagcggcatgtagagactccccagcctcctttactccctgctccagctcaccactcctttcatttggccttgtccaaccagcggaggagccctcctgaagaacctcctgacttctgttgtccgaagtgccagtatcaggctcctgatatggacactctacagatacatgtcatggagtgcatagag

SEQ ID NO: 992 - DNA, 1236 bp, Artificial Sequence
  Synthetic Polynucleotide
atgaacaagcacccctggaagaaccagctgagtgagacggtgcagcccagtggtggcccagcagaggaccaggacatgctgggtgaagaatcttctctggggaagcctgcaatgctacatctgccttcagagcagggtactcctgagaccctccagcgctgcctggaagagaatcaagagctccgagacgctatccggcagagcaatcagatgctgagggaacgctgtgaggagctgctgcatttccaggtcagccagcgggaggagaaggagttccttatgtgcaaattccaggaagcccggaagctggtggagagactgagcttggagaagcttgatcttcggagtcagagggaacaggccttaaaggagttggagcaactgaagaaatgccaacagcagatggctgaggacaaggcctctgtgaaagctcaggtgacatcattgctcggagaactccaggagagccagagccgtttggaggctgccaccaaggatcggcaagctttagagggaaggattcgagcagttagtgagcaggtcagacagctggagagtgagcgggaggtgctacagcagcagcacagcgtccaggtggaccagctgcgtatgcagaaccagagcgtggaggctgccttgcgaatggagcggcaggctgcttcagaggagaagcggaagctggctcagttgcaggcagcctatcaccaactcttccaagactacgacagccacattaagagcagcaagggcatgcagctggaagatctgaggcaacagctccagcaagctgaggaggccctggtagccgcacaggaattgattgataagctgaaagaggaggctgagcagcacaagattgtgatggagactgtgccagtcttgaaggcccaggcggatatctacaaggctgacttccaagctgagaggcatgcccgggagaagctggtggagaagaaggagtatttgcaggagcagctggagcagctgcagcgcgagttcaacaagctgaaagttggctgccatgagtcagccaggattgaggatatgaggaagcggcatgtagagactccccagcctcctttactccctgctccagctcaccactcctttcatttggccttgtccaaccagcggaggagccctcctgaagaacctcctgacttctgttgtccgaagtgccagtatcaggctcctgatatggacactctacagatacatgtcatggagtgcatagag

SEQ ID NO: 993 - DNA, 600 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggac

SEQ ID NO: 994 - DNA, 360 bp, Artificial Sequence
  Synthetic Polynucleotide
atgaataggcacctctggaagagccaactgtgtgagatggtgcagcccagtggtggcccggcagcagttcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcag

SEQ ID NO: 995 - DNA, 450 bp, Artificial Sequence
  Synthetic Polynucleotide
atgaataggcacctctggaagagccaactgtgtgagatggtgcagcccagtggtggcccggcagcagttcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctc

SEQ ID NO: 996 - DNA, 381 bp, Artificial Sequence
  Synthetic Polynucleotide
atgaataggcacctctggaagagccaactgtgtgagatggtgcagcccagtggtggcccggcagcagttcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcac

SEQ ID NO: 997 - DNA, 2016 bp, Artificial Sequence
  Synthetic Polynucleotide
atgcaaccagacatgtccttgaatgtcattaagatgaaatccagtgacttcctggagagtgcagaactggacagcggaggctttgggaaggtgtctctgtgtttccacagaacccagggactcatgatcatgaaaacagtgtacaaggggcccaactgcattgagcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatgagtactccgctttctgtaaaaggaaggataatttgggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgtttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaa

SEQ ID NO: 998 - DNA, 1187 bp, Artificial Sequence
  Synthetic Polynucleotide
agatctccatgggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgtttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaac

SEQ ID NO: 999 - DNA, 930 bp, Artificial Sequence
  Synthetic Polynucleotide
atgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctga

SEQ ID NO: 1000 - DNA, 930 bp, Artificial Sequence
  Synthetic Polynucleotide
atgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgaccgatccccatcaagtacaaggcaatgaagaaagagttccccagcatcctgaggttcatcactgtctgcgactacaccaacccctgcaccaaatcttggttctggactcgccttgccaaggccttgtccctgccctga

SEQ ID NO: 1001 - DNA, 2268 bp, Artificial Sequence
  Synthetic Polynucleotide
atgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 1002 - DNA, 2268 bp, Artificial Sequence
  Synthetic Polynucleotide
atgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 1003 - DNA, 2238 bp, Artificial Sequence
  Synthetic Polynucleotide
atggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 1004 - DNA, 2238 bp, Artificial Sequence
  Synthetic Polynucleotide
atggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 1005 - DNA, 342 bp, Artificial Sequence
  Synthetic Polynucleotide
atggccgagtgtcctacactgggagaagccgtgacagatcaccccgatagactgtgggcctgggagaaattcgtgtacctggacgagaagcagcacgcctggctgcctctgaccatcgagatcaaggaccggctgcaactgagagtgctgctgcggagagaagatgtggtgctgggcagacccatgacacccacacagatcggacctagcctgctgcctatcatgtggcagctctaccccgacggcagatacagaagcagcgacagcagcttttggcggctggtgtaccacatcaagatcgacggcgtggaagatatgctgctggaactgctgcccgacgac

SEQ ID NO: 1006 - DNA, 1917 bp, Artificial Sequence
  Synthetic Polynucleotide
atgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 1007 - DNA, 3591 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatcaccatgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcctcgagaccgatttctacgactacaaggacgacgatgacaagactagtggctccggcgagggcagaggaagtctactaacctgcggagatgtggaagaaaatcctggcccaatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctaa

SEQ ID NO: 1008 - DNA, 1260 bp, Artificial Sequence
  Synthetic Polynucleotide
atgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggac

SEQ ID NO: 1009 - DNA, 1839 bp, Artificial Sequence
  Synthetic Polynucleotide
atgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatgggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgtttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaac

SEQ ID NO: 1010 - DNA, 516 bp, Artificial Sequence
  Synthetic Polynucleotide
atggactggatttggcgcatccttttccttgtcggcgctgctaccggcgcgcattccttcgaaggcggaacgcgtttcgaaggcggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 1011 - DNA, 615 bp, Artificial Sequence
  Synthetic Polynucleotide
atggactggatttggcgcatccttttccttgtcggcgctgctaccggcgcgcattccttcgaaggcggaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 1012 - DNA, 1344 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtaggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcc

SEQ ID NO: 1013 - DNA, 1341 bp, Artificial Sequence
  Synthetic Polynucleotide
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcc

SEQ ID NO: 1014 - DNA, 1449 bp, Artificial Sequence
  Synthetic Polynucleotide
atgccacctcctcgcctcctcttcttcctcctcttcctcacccccatggaagtcaggcccgactacaaggacgacgatgacaaggaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgaaatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctcgagatcactgctcggccagtactatggcactggctgctgaggactggtggctggacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcc

SEQ ID NO: 1015 - DNA, 2025 bp, Artificial Sequence
  Synthetic Polynucleotide
atgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgccacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcc

SEQ ID NO: 1016 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1017 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1018 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1019 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1020 - DNA, 2769 bp, Artificial Sequence
  Synthetic Polynucleotide encoding a CAR with optional accessory module(s)
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1021 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagaggcggaggcggaagtggaggcggaggatctggcggcggaggctctgaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1022 - DNA, 2760 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccccgatttccagagcgtgacccctaaagaaaaagtgaccatcacctgtcgggccagcgagagcgtggacacattcggcatcagcttcatgaactggttccagcagaagcccgatcagagccccaagctgctgattcacgccgccagcaatcaaggcagcggagtgcctagcagattttccggctctggcagcggcaccgatttcaccctgaccatcaatagcctggaagccgaggatgccgccacctactactgccagcagagcaaagaggtgcccttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcagctcttggatgaactgggtccgacaggcccctggcaaaggactggaatgggtcggaagaatctaccccggcgacggcgacaccaactacaacggcaagttcaagggcagattcaccatcagccgggacgacagcaagaacagcctgtacctgcagatgaactccctgaaaaccgaggacaccgccgtgtactactgtgccagatccggcttcatcaccaccgtgctggacttcgattattggggccagggcaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1023 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggccattcagctcacacagagcccttctagcctgagcgcctctgtgggcgacagagtgaccatcacatgtagagccagccagggcatcagcagcgcccagcagaaacctggaaaggcccctaagctgctgatcctggcctggtacagcagcctggaaagcggagtgcctagcagattcagcggctacgatgcctctggcagcggcaccgatttcaccctgacaatatccagcctccagcctgaggacttcgccacctactactgccagcagttcaacagctacccctacaccttcggccagggcaccaagctggaaatcaaaggcggaggcggaagtggaggcggaggatctggcggcggaggctctgaagtgcaactggttcagagcggagccgaagtgaagaagcctggcgagagcctgaagattagctgcaaaggctccggctacagcttcagcagctcttggatcggctgggtccgacagatgcctggcaaaggactggaatggatgggcatcatctaccccgacgacagcgacaccagatacagccctagcttccagggccaagtgacaatcagcgccgacaagagcatcagaaccgcctacctccagtggtcctctctgaaggccagcgataccgccatgtactactgcgccagacacgtgaccatgatctggggagtgattatcgacttctggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1024 - DNA, 2820 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1025 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggactacgacggcgacagctacctgaactggtatcagcagaagcccggccagcctcctaagctgctgatctacgatgccagcaacctggtgtctggcatccctcctagattttccggcagcggctctggcaccgatttcaccctgaccatcagcagactggaacccgaggacttcgccgtgtaccactgtcagcagagcacagaggacccctggacatttggcggaggcaccaagctggaaatcaaaggcggaggcggaagtggaggcggaggatctggcggcggaggctctcaggtgcagctggttgaatctggcggcggacttgttgagcctggcggatctctgagactgagctgcatgagcggctacgccttcagcagctactggatgaactgggtccgacagatgcccggcaaaggactggaatggatgggccagatttggcctggcgacggcgataccaactacaaccccagcctgaagtccagagtgaccatcaccgccgatgagagcaccagcaccgcctacatggaactgtctagcctgaaggccgaggatacagccgtgtacttctgcgccagacgggaaaccacaaccgtgggcagatattactacgctatggactactggggccagggcaccctggttacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1026 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggacaactacggcatcagcttcatgaactggtatcagcagaagcccggccagcctcctaagctgctgatctacgccgccagcaatcaaggctctggcatccccagcagattttccggctctggaagcggcaccgacttcaccctgaccataagcagcctggaacctgaggacttcgccatgtacttttgccagcagagcaacgaggtgcccagaacctttggcggaggcaccaagctggaaatcaaaggcggaggcggaagtggaggcggaggatctggcggcggaggctctcaggtgcaactggttgagtctggcggcggacttgttgaacctggcggaagcctgagactgagctgcatgagcggctacgcctttagcagctcctggatgaactgggtccgacagatgcctggcaaaggactggaatggatgggcagaatctaccccggcgacggcgacaccaactacaacggcaagttcaaagaacgggtcaccatcaccgccgacgagagcacaagcaccgcctacatggaactgagcagcctgaaggccgaggataccgccgtgtacttctgcgccagaagcgagtattggggcaactactgggctatggactactggggccagggcacactggtcacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1027 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgcaaggccagtcagaacgtgggcacaaacgtggcctggtatcagcagaagcctggacagcctcctaagctgctgatctacagcgccacctaccggaactctggcatccctgccagattttctggcagcggctctggcaccgagttcaccctgaccatcaccaacgtgcagagcaaggacctggccgactacttctacttctgccagtacaacagatacccctacaccagcggcggaggcaccaagctggaaatcaaaagaggcggaggcggaagtggaggcggaggatctggcggcggaggctctcaggtgcaactggttgaatcaggcggaggactggtggaacctggcggatctctgagactgagctgtatgagcggctacgccttcagcagctactggatgaactgggtccgacagatgcccggcaaaggactggaatggatgggccaaatctaccccggcgacggcgacaccaactacaacggcaagttcaagggcagagtgacaatcaccgccgacgagagcacaagcaccgcctacatggaactgagcagcctgaaggccgaggataccgccgtgtacttctgcgccagaaagaccatcagcagcgtggtggatttctacttcgacaactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1028 - DNA, 2793 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattccagatcgtgctgacacagtctccagccacactgagcgcttctccaggcgagaaggccaccatgacatgttctgccagcagcggcgtgaactacatgcactggtatcagcagaagcccggcacaagccccaagcggtggatctacgataccgacaagacagccagcggagtgcccgccagattttctggctctggcagcggcacatcctacagcctgacaatcagcagcatggaagccgaggatgccgccacctactactgtcaccagagaggcagctacaccttcggcggaggcaccaagctggaaatcaaaggcggaggcggaagtggaggcggaggatctggcggcggaggctctcaagttcagctggaacaacctggcgctgaggtggtcaaaccaggggcctctgtgaaggtgtcctgcaagacaagcggctacacattcaccagcaactggatgcactgggtcaagcagacccctggcaaaggactggaatggatcggcgagatcgaccccagcgactcctacaccaactacaaccagaagttcgacggcaaggccaagctgaccgtggacaagtctagcagcaccgcctacatggaagtgtccgatctgaccgccgaagatagcgccacatattactgcgccagaggcagcaacccctactactacgctatggactattggggccagggcaccagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1029 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1030 - DNA, 2775 bp, Artificial Sequence
  Synthetic Polynucleotide encoding a CAR with optional accessory module(s)
atggccttaccagtgaccgccttgctcctgccgctggccttgctgctccacgccgccaggccggacgacatccagctgacccagagccccagcagcctgagcgccagcgtgggcgacagagtgaccatcacctgcaaggccagccagagcgtggactacgacggcgacagctacctgaactggtaccagcagatccccggcaaggcccccaagctgctgatctacgacgccagcaacctggtgagcggcatcccccccagattcagcggcagcggcagcggcaccgactacaccttcaccatcagcagcctgcagcccgaggacatcgccacctaccactgccagcagagcaccgaggacccctggaccttcggcggcggcaccaagctgcagatcaagagaggcggaggcggaagtggaggcggaggatctggcggcggaggctctcaggtgcagctgcagcagagcggcgccgaggtgaagaagcccggcagcagcgtgaaggtgagctgcaaggccagcggctacgccttcagcagctactggatgaactgggtgagacagagacccggccagggcctggagtggatcggccagatttggcccggcgacggcgacaccaactacaacggcaagttcaagggcagagccaccatcaccgccgacgagagcaccaacaccgcctacatggagctgagcagcctgagaagcgaggacaccgccttctacagctgcgccagaagagagaccaccaccgtgggcagatactactacgctatggactactggggccagggcaccaccgtgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1031 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1032 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1033 - DNA, 2781 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1034 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1035 - DNA, 2772 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1036 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1037 - DNA, 2766 bp, Artificial Sequence
  Synthetic Polynucleotide encoding a CAR with optional accessory module(s)
atgaggctccctgctcagctcctggggctgctaatgctctgggtctctggaagcagtggggatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaaggcggaggcggaagtggaggcggaggatctggcggcggaggctctgaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1038 - DNA, 2841 bp, Artificial Sequence
  Synthetic Polynucleotide encoding a CAR with optional accessory module(s)
atggccttaccagtgaccgccttgctcctgccgctggccttgctgctccacgccgccaggccggccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1039 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1040 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1041 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1042 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1043 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1044 - DNA, 2781 bp, Artificial Sequence
  Synthetic Polynucleotide encoding a CAR with optional accessory module(s)
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1045 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1046 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1047 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1048 - DNA, 3126 bp, Artificial Sequence
  Synthetic Polynucleotide encoding a CAR with optional accessory module(s)
atggttaggggcgttccattcagacatctgcttctggtcttgcagcttgcactcttgcccgctgccacccagggcaaaaaagtggtgctgggcaagaaaggcgacaccgtggaactgacctgcaccgccagccagaagaagtccatccagttccactggaagaacagcaaccagatcaagatcctgggcaaccagggcagcttcctgaccaagggacccagcaagctgaacgacagagccgacagcagacggtccctgtgggaccagggcaatttcccactgattatcaagaacctgaagatcgaggacagcgacacctacatctgcgaggtggaagatcagaaagaagaggtgcaactgctggtgttcggcctgaccgccaactccgacacccatctgctccagggccagagcctgaccctgacactggaaagccctccaggcagctcccccagcgtgcagtgtagaagcccacgaggcaagaacatccagggaggcaaaacattgtcagtgtcccaactggaactccaggactccggcacctggacctgtaccgtgctccagaaccagaaaaaggtggagttcaagatcgacatcgtggtgctggccttccagaaagcctctggcggaggcggaagtggaggcggaggatctggcggcggaggctctatctaccaggaactgacacaactgaaggccgccgtggaacggctgtgccacccttgtccttgggagtggaccttctttcagggcaactgctacttcatgagcaacagccagcggaactggcacgacagcatcaccgcctgcaaagaagtgggagcccaactggtcgtgattaagagcgccgaggaacagaacttcctccaactccagagcagcagaagcaacagattcacctggatgggcctgagcgacctgaaccaggaaggcacctggcagtgggtggacggatctcctctgctgcccagcttcaagcagtattggaaccggggcgagcccaacaacgtgggcgaagaggattgcgccgagttcagcggcaacggctggaacgacgacaagtgcaacctggctaagttctggatctgcaagaagtccgccgcctcctgtagccgggatgaggaacagttcctgagccctgcccctgccacccctaatcctccaccagctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1049 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1050 - DNA, 2754 bp, Artificial Sequence; identical to SEQ ID NO: 1049
  Synthetic Polynucleotide encoding a CAR with optional accessory module(s)

SEQ ID NO: 1051 - DNA, 2595 bp, Artificial Sequence
  Synthetic Polynucleotide encoding a CAR with optional accessory module(s)
atggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1052 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1053 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1054 - DNA, 2760 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1055 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1056 - DNA, 2760 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1057 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1058 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1059 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgatagagtgaccatgacctgtagagccagcagcagcgtgtcctacatccactggttccagcagaagcctggcaaggcccctaagccttggatctacgccaccagcaatctggcctctggcgtgccagtcagattttctggcagcggctctggcaccgactacaccttcacaatatccagcctccagcctgaggacattgccacctactactgccagcagtggacctccaatcctcctacctttggcggaggcaccaagctggaaatcaaaggcggaggcggaagtggaggcggaggatctggcggcggaggctctcaggttcagctccagcagtctggggccgaagtgaagaaacctggcagctccgtgaaagtgtcctgcaaggccagcggctacacctttaccagctacaacatgcactgggtcaagcaggcccctggacagggactcgaatggatcggagccatctatcccggcaacggcgacacctcctacaaccagaagttcaagggcaaagccacactgaccgccgacgagagcacaaacaccgcctacatggaactgagcagcctgagaagcgaggacaccgccttctactactgtgcccggtctacctactacggcggcgactggtactttgacgtgtggggccagggaaccaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1060 - DNA, 2781 bp, Artificial Sequence
  Synthetic Polynucleotide encoding a CAR with optional accessory module(s)
atggccttaccagtgaccgccttgctcctgccgctggccttgctgctccacgccgccaggccgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1061 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1062 - DNA, 2751 bp, Artificial Sequence; identical to SEQ ID NO: 1058
  Synthetic Polynucleotide encoding a CAR with optional accessory module(s)

SEQ ID NO: 1063 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1064 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1065 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1066 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1067 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1068 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1069 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1070 - DNA, 2736 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1071 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1072 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1073 - DNA, 2772 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1074 - DNA, 2760 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1075 - DNA, 2838 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1076 - DNA, 2835 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1077 - DNA, 2883 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1078 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1079 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1080 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1081 - DNA, 2769 bp, Artificial Sequence
  Synthetic Polynucleotide encoding a CAR with optional accessory module(s)
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1082 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1083 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1084 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1085 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1086 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1087 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1088 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1089 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1090 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1091 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1092 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1093 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1094 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1095 - DNA, 2733 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1096 - DNA, 2826 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1097 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1098 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1099 - DNA, 2778 bp, Artificial Sequence
  Synthetic Polynucleotide encoding a CAR with optional accessory module(s)
atggccttaccagtgaccgccttgctcctgccgctggccttgctgctccacgccgccaggccggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1100 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1101 - DNA, 2736 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1102 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1103 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1104 - DNA, 2760 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1105 - DNA, 2736 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1106 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1107 - DNA, 2775 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1108 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1109 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1110 - DNA, 2721 bp, Artificial Sequence
  Synthetic Polynucleotide encoding a CAR with optional accessory module(s)
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1111 - DNA, 2736 bp, Artificial Sequence
  Synthetic Polynucleotide encoding a CAR with optional accessory module(s)
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1112 - DNA, 2772 bp, Artificial Sequence
  Synthetic Polynucleotide encoding a CAR with optional accessory module(s)
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1113 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1114 - DNA, 2760 bp, Artificial Sequence
  Synthetic Polynucleotide encoding a CAR with optional accessory module(s)
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1115 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1116 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1117 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1118 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1119 - DNA, 2793 bp, Artificial Sequence
  Synthetic Polynucleotide encoding a CAR with optional accessory module(s)
atggccttaccagtgaccgccttgctcctgccgctggccttgctgctccacgccgccaggccggacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctggcggaggcggaagtggaggcggaggatctggcggcggaggctctcaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1120 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1121 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1122 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1123 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1124 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1125 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1126 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1127 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1128 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1129 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1130 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1131 - DNA, 2796 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgagggcggaggcggaagtggaggcggaggatctggcggcggaggctctttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1132 - DNA, 2898 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagtctcgagggaggaggcggctccgggggaggcggaagtggaggcggaggatctgggtctggaggaagcggatctggaggctcagggtcagggggctcaggcagtggaggctctttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1133 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1134 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1135 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacagcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccggcggaggcggaagtggaggcggaggatctggcggcggaggctctgaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1136 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgggcggaggcggaagtggaggcggaggatctggcggcggaggctctgacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1137 - DNA, 2400 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1138 - DNA, 2826 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagggcggaggcggaagtggaggcggaggatctggcggcggaggctctttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1139 - DNA, 2883 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagggaggaggcggctccgggggaggcggaagtggaggcggaggatctgggtctggaggaagcggatctggaggctcagggtcagggggctcaggcagtggaggctctttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1140 - DNA, 2727 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1141 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1142 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1143 - DNA, 2769 bp, Artificial Sequence
  Synthetic Polynucleotide encoding a CAR with optional accessory module(s)
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1144 - DNA, 2760 bp, Artificial Sequence
  Synthetic Polynucleotide encoding a CAR with optional accessory module(s)
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1145 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1146 - DNA, 2784 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1147 - DNA, 2772 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1148 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaaggcggaggcggaagtggaggcggaggatctggcggcggaggctctcaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1149 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1150 - DNA, 2673 bp, Artificial Sequence
  Synthetic Polynucleotide encoding a CAR with optional accessory module(s)
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1151 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggacctggaaaccaccctgacacagagccctgccaccctgagtgtgtccccaggcgagagagtgaccctgagctgtagagccagccagagcgtgggcagcaacctggcctggtatcagcagaagttcggccaggcccccagactgctgatctacgacgccagcacaagagccaccggcatccccgccagattttctggcagcggctccggcaccgagttcaccctgaccatcagcagactggaacccgaggacttcgccgtgtactactgccaccagtacggcagcagccccagaacctttggacagggcaccaaggtggacatcaagcggggcggaggcggaagtggaggcggaggatctggcggcggaggctctcaggtgcaactggtgcagagcggagccgaagtgaagaaacctggggccagcgtgaaggtgtcctgcaaggccagcggctacacctttaccacctacggcatctcttgggtgcgccaggctcctggacagggactggaatggatgggctggatcagcgcctacaacggccacaccaactacgcccagatgctccagggcagagtgaccatgaccaccgacaccagcacctccaccgcctacatggaactgcggggcctgagaagcgacgacaccgccgtgtattattgcgccagagaagcctacgcctcctacggcagcggcagctactggaccgattattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1152 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1153 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1154 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1155 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1156 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1157 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1158 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1159 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1160 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1161 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1162 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1163 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacaacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagagaggcggaggcggaagtggaggcggaggatctggcggcggaggctctcaagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1164 - DNA, 2775 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacagggcggaggcggaagtggaggcggaggatctggcggcggaggctctgaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1165 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1166 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1167 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgctgacccagagccccgccagcctggccgtgagcctgggccagagcgtgaccatcagctgcagagccagcgagagcgtggagtactacggcaccagcctgatgcagtggtaccagcagaagcccggccagccccccaagctgctgatctacgccaccagcaacgtggagagcggcgtgcccgccagattcagcggcagcggcagcggcaccgacttcagcctgaacatccaccccgtggaggaggacgacatcgccatgtacttctgccagcagagcagaaagctgcccagcaccttcggcggcggcaccaagctggagatcaagggcggaggcggaagtggaggcggaggatctggcggcggaggctctgacgtgagactgcaggagagcggccccggccaggtgaagcccagccagaccgtgagcctgacctgcagcgtgaccggctacagcatcaccaacggcaaccactggtggaactggatcagacaggtgagcggcagcaagctggagtggatcggctacatcagcagcagcggcagcaccgacagcaaccccagcctgaagagcagaatcagcatcaccagagacaccagcaagaaccagctgttcctgcagctgaacagcgtgaccaccgaggacatcgccacctactactgcgccagaggctactacttcgactactggggccagggcaccaccctgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1168 - DNA, 2382 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1169 - DNA, 2187 bp, Artificial Sequence
  Synthetic Polynucleotide encoding a CAR with optional accessory module(s)
atggactggatttggcgcatccttttccttgtcggcgctgctaccggcgcccattccttcgaaggcagcggattcgaatacgccaaagagatgcggaacgcctactgggagatcgccctgctgcccaatctgaccaaccagcagaagagagcccccatcagaaagctgtacgacgacccctcccagagcagcgagctgctgtctgaggctaaaaaactgaacgatagccagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1170 - DNA, 2400 bp, Artificial Sequence
  Synthetic Polynucleotide encoding a CAR with optional accessory module(s)
atggccctgcccgtgacagccctgctgctgcctctggctctgctgctgcacgccgccagacccgatgaattcggctctgacctgggcatcaagctgctgttcgccgctgccaagggccaggacgacgaagtgcggattctgctggctgctggggccgacgtgaacgccaaggatttcgagggctacacccccctgcacgtggccgcctatgatggacacctggaaatcgtggaagtgctgctgaaggctggcgctgatgtgaatgccaaagacagccagggccggacccctctgcatgaagccgcctacagcggccatctggaaattgtggaagtgctgctgaaagccggggcagacgtgaacgctcaggacgacgctggcgagacaccagccgatctggctgcagcttggggccacgaagatatcgccgaggtgctgcagaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1171 - DNA, 2397 bp, Artificial Sequence
  Synthetic Polynucleotide encoding a CAR with optional accessory module(s)
atggactggatttggcgcatccttttccttgtcggcgctgctaccggcgcccattccttcgaaagaagcgatctgggaaagaagctgctggaagctgccagagccggacaggatgatgaagtgcgcatcctgatggcaaacggcgcagatgtgaacgcaaaggacgagtacggcctgacccccctgtacctggctacagcccacgggcacctggaaattgtggaagtgctgctgaagaacggcgctgacgtgaacgccgtggacgccatcggctttaccccactgcatctggccgctttcatcgggcatctcgaaatcgcagaggtgctgctgaaacacggggccgatgtgaatgcccaggacaagttcggcaagaccgccttcgacatcagcatcggcaacggcaacgaggacctggccgagatcctgcagaaactgaacacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1172 - DNA, 2853 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgagggaggaggcggctccgggggaggcggaagtggaggcggaggatctgggtctggaggaagcggatctggaggctcagggtcagggggctcaggcagtggaggctctttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1173 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1174 - DNA, 2382 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1175 - DNA, 2202 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgtggacaacaagttcaacaaagagcggtacagcgcctactacgagatttggcaactgcccaacctgaacgtgcggcagaaggccgccttcatcggatctctgcaggacgaccctagccagagcgccaatctgctggccgaggccaagaagctgaacgacgcccaggcccctaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1176 - DNA, 2868 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgagggaggaggcggctccgggggaggcggaagtggaggcggaggatctgggtctggaggaagcggatctggaggctcagggtcagggggctcaggcagtggaggctctttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1177 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1178 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1179 - DNA, 2784 bp, Artificial Sequence
  Synthetic Polynucleotide encoding a CAR with optional accessory module(s)
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1180 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1181 - DNA, 2769 bp, Artificial Sequence
  Synthetic Polynucleotide encoding a CAR with optional accessory module(s)
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1182 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1183 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagagaggcggaggcggaagtggaggcggaggatctggcggcggaggctctgaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1184 - DNA, 2769 bp, Artificial Sequence
  Synthetic Polynucleotide encoding a CAR with optional accessory module(s)
atggccttaccagtgaccgccttgctcctgccgctggccttgctgctccacgccgccaggccgagctacgagctgacacagcctccatccgtgtctggcacacctggacagagagtggctatctcctgtagcggcagcagcagcaacatcggcaccagaatggtcacctggtatcagcacgtgccaggcacagcccctaagctgctgatcttcaacaacaaccagcggcctagcggcgtgcccgatagattttctgccagcaagagcggcacaagcgccagcctggctatcatcggactccagtctgacgacgaggccgactactactgtgccacctgggacgacaacgtgaagtcctacgtgttcggcaccggcaccaaagtgacagtgcttggaagtagaggcggaggcggaagtggaggcggaggatctggcggcggaggctctcttgaaatggcccaggttcagctccagcagtggggagctggactgctgaagcctagcgagacactgagcctgacctgtgctgtgtacggcggcagcttcagcggctactactggtcctggatcagacagcctcctggcaaaggactggaatggatcggcgagatcaaccacagcggctccaccaactacaaccccagcctgaagtccagagtgaccatcagcgtggacaccagcaagaaccagttctccctgaagctgagcagcgtgacagccgctgataccgccgtgtactattgcgctagagcccctcagtcttggtacgtgggagatgtgtggggccagggcacactggttacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1185 - DNA, 2760 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagcctgtctgtggcccctggaaagacagccagcatcacatgcggcggcaacaacatcggcatgaagtccgtgcactggtatcagcagaggccaggacaggctcctgtgctggtcatctactacgacagcgacagaccctctggcatccccggcagattttccggcagcaactctggcaataccgccacactgaccatctccagagtggaagctggcgacgaggccgactactactgccaagtgtgggataccaccggcgatcaccctggctatgtgtttggcaccggcaccaaagtgacagtgcttggcggaggcggaagtggaggcggaggatctggcggcggaggctctcaagttcaactggttcagagcggagccgaagtgaagaaacctggcagcagcgtgaaggtgtcctgcaaagcaagcggcggcacctttagcagctacgccatctcttgggtccgacaggcacctggacaaggactggaatggatgggcggcatcatccccatcttcggcacagccaattacgcccagaaattccagggcagagtgaccatcaccgccgacgagtctacaagcaccgcctacatggaactgagcagcctgagaagcgaggacaccgccgtgtactattgtgccagaggcgtgtacggctacagcggctctgccccttatgatgagtggggccagggaaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1186 - DNA, 2778 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcggggcggaggcggaagtggaggcggaggatctggcggcggaggctctcaggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1187 - DNA, 2760 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagagaggcggaggcggaagtggaggcggaggatctggcggcggaggctctgaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1188 - DNA, 2709 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1189 - DNA, 2376 bp, Artificial Sequence
  Synthetic Polynucleotide encoding a CAR with optional accessory module(s)
atggactggatttggcgcatccttttccttgtcggcgctgctaccggcgcccattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1190 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1191 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1192 - DNA, 2769 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagggcggaggcggaagtggaggcggaggatctggcggcggaggctctcagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1193 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1194 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1195 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1196 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1197 - DNA, 2700 bp, Artificial Sequence
  Synthetic Polynucleotide encoding a CAR with optional accessory module(s)
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttcttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1198 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1199 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1200 - DNA, 2754 bp, Artificial Sequence; identical to SEQ ID NO: 1085
  Synthetic Polynucleotide encoding a CAR with optional accessory module(s)

SEQ ID NO: 1201 - DNA, 2772 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaagggcggaggcggaagtggaggcggaggatctggcggcggaggctctgaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1202 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaagggcggaggcggaagtggaggcggaggatctggcggcggaggctctcaactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1203 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1204 - DNA, 2403 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1205 - DNA, 2892 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcctcgagggaggtagcggctccgggggaggcggaagtggaggcggaggatctgggtctggaggaagcggatctggaggctcagggtcagggggctcaggcagtggaggctctttcgaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1206 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1207 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1208 - DNA, 2739 bp, Artificial Sequence
  Synthetic Polynucleotide encoding a CAR with optional accessory module(s)
atggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1209 - DNA, 2742 bp, Artificial Sequence
  Synthetic Polynucleotide encoding a CAR with optional accessory module(s)
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1210 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaaggcggaggcggaagtggaggcggaggatctggcggcggaggctctcaggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1211 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaagggcggaggcggaagtggaggcggaggatctggcggcggaggctctgaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1212 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggaccaggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagcggcggaggcggaagtggaggcggaggatctggcggcggaggctcttcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1213 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaaggcggaggcggaagtggaggcggaggatctggcggcggaggctctcaggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1214 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1215 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1216 - DNA, 2769 bp, Artificial Sequence
  Synthetic Polynucleotide encoding a CAR with optional accessory module(s)
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1217 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1218 - DNA, 2454 bp, Artificial Sequence
  Synthetic Polynucleotide encoding a CAR with optional accessory module(s)
atggccttaccagtgaccgccttgctcctgccgctggccttgctgctccacgccgccaggccgctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtgggcggaggcggaagtggaggcggaggagacacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1219 - DNA, 2736 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1220 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1221 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctttcgaagtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1222 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctgaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1223 - DNA, 2457 bp, Artificial Sequence
  Synthetic Polynucleotide encoding a CAR with optional accessory module(s)
atggccttaccagtgaccgccttgctcctgccgctggccttgctgctccacgccgccaggccgggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1224 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1225 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1226 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1227 - DNA, 2796 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1228 - DNA, 2787 bp, Artificial Sequence
  Synthetic Polynucleotide encoding a CAR with optional accessory module(s)
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1229 - DNA, 2709 bp, Artificial Sequence
  Synthetic Polynucleotide encoding a CAR with optional accessory module(s)
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1230 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1231 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1232 - DNA, 2733 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1233 - DNA, 2733 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1234 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaaggcggaggcggaagtggaggcggaggatctggcggcggaggctctgaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1235 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacgacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaaggcggaggcggaagtggaggcggaggatctggcggcggaggctctgaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1236 - DNA, 2841 bp, Artificial Sequence
  Synthetic Polynucleotide encoding a CAR with optional accessory module(s)
atggccttaccagtgaccgccttgctcctgccgctggccttgctgctccacgccgccaggccggacgaattccaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggaggaggcggctccgggggaggcggaagtggaggcggaggatctgggtctggaggaagcggatctggaggctcagggtcagggggctcaggcagtggaggcagcttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1237 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1238 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1239 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1240 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1241 - DNA, 2778 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1242 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1243 - DNA, 2760 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1244 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1245 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaagaggcggaggcggaagtggaggcggaggatctggcggcggaggctctcaggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1246 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagagaggcggaggcggaagtggaggcggaggatctggcggcggaggctctcaggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1247 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1248 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1249 - DNA, 2775 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1250 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1251 - DNA, 2736 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1252 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1253 - DNA, 2517 bp, Artificial Sequence
  Synthetic Polynucleotide encoding a CAR with optional accessory module(s)
atggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggaccctaatgccatcttcctgagcttccaacacctgctccgaggaaaggtgcgtttcctgatgcttgtaggagggtccaccctctgcgtcaggcgggccccacccaccacagctgtccccagcagaacctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1254 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1255 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1256 - DNA, 2691 bp, Artificial Sequence
  Synthetic Polynucleotide encoding a CAR with optional accessory module(s)
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1257 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1258 - DNA, 2736 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1259 - DNA, 2769 bp, Artificial Sequence
  Synthetic Polynucleotide encoding a CAR with optional accessory module(s)
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1260 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1261 - DNA, 2769 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcggggcggaggcggaagtggaggcggaggatctggcggcggaggctctgaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1262 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcggggcggaggcggaagtggaggcggaggatctggcggcggaggctctcaactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1263 - DNA, 2772 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagagaggcggaggcggaagtggaggcggaggatctggcggcggaggctctgaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1264 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1265 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggaccagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtggcggaggcggaagtggaggcggaggatctggcggcggaggctctcaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1266 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1267 - DNA, 2793 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1268 - DNA, 2775 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1269 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1270 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1271 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1272 - DNA, 2721 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1273 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1274 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1275 - DNA, 2763 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagagaggcggaggcggaagtggaggcggaggatctggcggcggaggctctgaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1276 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1277 - DNA, 2742 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1278 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1279 - DNA, 2745 bp, Artificial Sequence; identical to SEQ ID NO: 1278
  Synthetic Polynucleotide encoding a CAR with optional accessory module(s)

SEQ ID NO: 1280 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctccagcagtctgatgccgagctggtcaagcctggcagcagcgtgaagattagctgcaaggccagcggctacaccttcaccgatcacgccatccactgggtcaagcagaagcctgagcagggcctcgaatggatcggccactttagccctggcaacaccgacatcaagtacaacgacaagttcaagggcaaagccacactgaccgtggacagaagcagcagcacagcctacatgcagctgaacagcctgaccagcgaggacagcgccgtgtacttctgcaagaccagcaccttctttttcgactactggggccagggcacaaccctgacagtttcttctggcggaggcggaagtggaggcggaggatctggcggcggaggctctgaactggttatgacacagagccccagcagcctgacagtgacagccggcgagaaagtgaccatgatctgcaagtctagccagagcctgctgaactccggcgatcagaagaactacctgacctggtatcagcagaaacccggccagcctcctaagctgctgatcttctgggccagcaccagagaaagcggcgtgcccgatagattcacaggcagcggcagcggaaccgacttcaccctgacaatcagctctgtgcaggccgaggacctggccgtgtattactgccagaacgactacagctaccctctgacctttggagccggcaccaagctggaactgaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1281 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggtgcagcctggaagaagcctgagactgtcttgtgccgccagcggcttcaccttcgacgattatgccatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactactgcgccaaagacaaaggcggaggctactacgacttttggagcggcagcgattattggggccagggcacactggtcacagtgtctagcggcggaggcggaagtggaggcggaggatctggcggcggaggctcttcttctgagctgacacaggaccctgccgtgtctgttgctctgggccagacagtgcggattacctgtcagggcgatagcctgagaagctactacgcctcctggtatcagcagaagccaggccaggctcctgtgctggtcatctacggcaagaacaacagacccagcggcatccccgatagattcagcggaagcagctctggcaataccgccagcctgacaattactggcgctcaggccgaggacgaggccgactactactgcaacagcagagatagcagcggctgggttttcggcggaggcacaaaactgacagtgctgacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1282 - DNA, 2781 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgctgagcaacagcgacacctggaactggatcagacagagccctagcagaggactggaatggctgggcagaacctaccacagaagcacttggtacgacgactacgccagctctgtgcggggcagagtgtccatcaatgtggacaccagcaagaaccagtacagcctgcaactgaacgccgtgacacctgaggataccggcgtgtactactgcgccagagacagactccaggacggcaactcttggagcgacgcctttgatgtgtggggccagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactggtgtacgtgttcggcacaggcaccaaagtgaccgtgcttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1283 - DNA, 2775 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggttcagtctggggccgaagtgaagaaacctggggcctctgtgaaggtgtcctgcaaggcttccggctacacctttaccagctacgacatcaactgggtccgacaggccacaggccaaggactggaatggatgggctggatgaaccccaacagcggcaataccggctacgcccagaaattccagggcagagtgaccatgaccagaaacaccagcatcagcaccgcctacatggaactgagcagcctgagaagcgaggacaccgccgtgtactattgcgccagaggcgacagcaactactggtcctactacggcatggacgtgtggggccagggaacactggttacagtttctagcggcggaggcggaagtggaggcggaggatctggcggcggaggctctggcggtggtggatctcaatctgtgctgacccagcctagatccgtgtctggctctcctggacagagcgtgaccatctcttgtaccggcaccagctctgatgtcggcggctacaattacgtgtcctggtatcagcagcaccccggcgaagcccctaagctgattatctacgacgccgacaagcggcccagcggcatcagcaatagattcagctctggcaagagcggcaacaccgccagcctgacaatcagcggactccaggtggaagatgaggccgactactactgctgctcctatgccggcggaagcacctgggttttcggaggcggtacaaaagtgaccgtgctgacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1284 - DNA, 2781 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgtcctctaatagcgccgcctggaactggatcagacagagccctagcagaggactggaatggctgggcagaacctactaccgcagcaagtggtacagcgactacgccgtgtccgtgaagtcccggatcaccatcaatcccgacaccagcaagaaccagttcagcctgcaactgaacagcgtgacccctgaggataccgccgtgtactactgcgccagagatccctacgacttttggagcggctaccccgacgcctttgacatctggggacagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaaagtgattatcagcgaagtgaacaacagacccagcggcgtgtcccacagattcagcggctctaagtctggcaacaccgccagcctgacaatctctggactgcaagccgaggacgaggccgactacttctgtagcagctacaccagcggcagaaccctgtacgtgttcggcacaggcagcaaagtgacagtgctgggaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1285 - DNA, 2778 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgattccatgctgagcaacagcgacacctggaactggatcagacagagccccagcagaggcctggaatggctgggcagaacataccacagaagcacttggtacgacgactacgccagctctgtgcggggcagagtgtccatcaatgtggacaccagcaagaaccagtacagcctgcaactgaacgccgtgacacctgaggataccggcgtgtactactgtgccagagtgcggctccaggacggcaattcttggagcgacgcctttgatgtgtggggccagggcacaatggtcaccgtttctagcggcggaggcggaagtggaggcggaggatctggcggcggaggctctcaatctgctctgacacagcctgccagcgcctctggatctcctggacagagcgtgaccatctcctgtaccggcacctcttctgatgtcggcggctacaactacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactgtacgtgttcggcacaggcacccagctcacagttcttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1286 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1287 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgtactggtatcagcagaagcccggacaggcccctagactgctgatctacagaaccagcaacctggcctctggcatccccgccagattttctggctctggcagcggcaccgatttcaccctgaccataagcagcctggaacctgaggacttcgccgtgtactactgccagcagtaccacagctaccccaccacctttggacagggcaccaaggtggaaatcaagcggacagttggcggaggcggaagtggaggcggaggatctggcggcggaggctctgaagtgcagctggttgaatcaggtggcggcctggttcaacctggcggatctctgagactgtcttgtgccgccagcggcttcagcttcaacacctacgccatgaactgggtccgacaggctcctggcaaaggactggaatgggtgtcccacatcagaagcaagagcaacaacttcgccacctactacgccgacagcgtgaaggacagattcaccatcagccgggacaacgccaagaacagcctgtacctccagatgaactccctgagagccgaggacaccgccgtgtattattgcgccagacaaggcggcgacttccctatggattattggggccagggcaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1288 - DNA, 2739 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1289 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacatgtagagccagccaggacatcagcaagtacctgaactggtatcagcagaagcccggcaaggcccctaagctgctgatctaccacaccagcagactgcacagcggcgtgccaagcagattttctggcagcggctctggcaccgacttcaccctgacaatatccagcctccagcctgaggacttcgccacctactattgccagcagggcaacaccctgccttacacctttggcggcggaacaaaggtggaaatcaaaggcggaggcggaagtggaggcggaggatctggcggcggaggctctcaagttcagctgcaagagtctggccctggcctggtcaagcctagccaaacactgagcctgacctgtaccgtcagcggagtgtccctgcctgattatggcgtgtcctggatcagacagcctcctggcaaaggactggaatggatcggcgtgatctggggcagcgagacaacctactacaacagcgccctgaagtccagagtgctgatctccgtggacaccagcaagaaccaggtgtccctgaagctgagcagcgtgacagccgctgataccgccgtgtactactgcgccagacactactactacggcggcagctacgctatggactattggggccagggcaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1290 - DNA, 2766 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtccatctacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcctcctttcacattcggccctggcaccaaggtggacatcaaaggcggaggcggaagtggaggcggaggatctggcggcggaggctctcaggtgcagcttgttgaaagcggaggcggagttgtgcagcctggcagaagtctgagactgtcttgtgccgccagcggcttcaccttcagcagctatggaatgcactgggtccgacaggcccctggcaaaggacttgaatgggttgccgtgatctgggacgacggcagcaacaagtattacgtggacagcgtgaagggcagattcaccatcagccgggacaacagcaagaacaccctgtacctccagatgaacagcctgagagccgaggacacagccgtgtattattgcgccagagatgactactacggcagcggctccttcaacagctactatggcacagacgtgtggggccagggcacaacagttaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1291 - DNA, 2721 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctgaagtgcaactggttcaatctggcggcggactggttcatccaggcggttctctgagactgagctgtgccggctctggcttcaccttcagcacctacctgatgtactgggtccgacaggcccctggcaagacactggaatgggtgtccgctattggcagcggaggcgatacctactacgccgactctgtgaagggcagattcaccatcagccgggacaacgccaagaacagcctgtacctccagatgaactccctgagagccgaggacatggccgtgtactactgtgccagaggactcggctattggggccagggaacactggtcacagtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1292 - DNA, 2733 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccatcatgtccgcttctcccggcgagaaagtgaccatcacatgtagcgccagcagcagcgtgtcctacatgcactggttccagcagaagcccggcacaagccctaagctgtggatctacagcaccagcaatctggcctctggcgtgccagccagattttctggctctggcagcggcaccagctacagcctgacaatcagcagaatggaagccgaggacgccgccacctactactgtcagcagagaagcagctaccctcctacctttggcggaggcaccaagctggaaatcaaaggcggaggcggaagtggaggcggaggatctggcggcggaggctctcaggttcagctccagcagagcggagccgagcttatgaagcctggcgcttccgtgaagatcagctgcaaggccaccggctacaccttcagcagctactggatcgagtgggtcaagcagaggcccggacatggcctggaatggatcggagagatcctgcctggaagcggcagcaccaactacaacgagaagttcaagggcaaagccaccttcaccgccgacaccagcagcaacacagcctatatgcagctgagcagcctgaccagcgaggacagcgccgtgtactactgcgccagatacgactacccttggtttgcctattggggccagggcaccctggttacagtttctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1293 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagccctagcagcctgacagtgacagccggcgagaaagtgaccatgagctgcaagagcagccagagcctgctgaacagcggcaaccagaagaactacctgacctggtatcagcagaagcccggccagcctcctaagctgctgatctactgggccagcaccagagaaagcggcgtgcccgatagattcacaggcagcggcagcggaaccgacttcaccctgacaatcagctctgtgcaggccgaggatctggccgtgtactactgccagaacgactacagctaccccttcacctttggctccggcaccaagctggaaatcaaaggcggaggcggaagtggaggcggaggatctggcggcggaggctctcaagttcagctgcaacagcctggggccgaactcgttagacctggcgcttctgtgaagctgtcctgcaaggccagcggctacacctttaccagctactggatcaactgggtcaagcagcggcctggacagggcctcgaatggatcggcaatatctaccccagcgacagctacaccaactacaatcagaagttcaaggacaaggccacactgaccgtggacaagtctagcagcaccgcctacatgcagctgagcagccctacaagcgaggacagcgccgtgtattattgcacccggtcttggcggggcaacagcttcgattattggggccagggcacaaccctgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1294 - DNA, 2751 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1295 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1296 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1297 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccggagctggtcatgacacagagccctgcttctctggccgtgtcactgggacagagagccaccatctcttgcagagccagcgagagcgtggacagctacggcaagagcttcatgcactggtatcagctcaagcccggccagcctcctaagctgctgatctacagagcctccaacctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaagctggaaatcaaaggcggaggcggaagtggaggcggaggatctggcggcggaggctctgaagtgcagctcgaacagtctggccccgagcttgtgaaacctggcgcttccgtgaagatgagctgcaaggccagcggctacaccttcaccaactactacatgaaatgggtcaagcagagccacggcaagtccctggaatggatcggcgatctgaaccccaacaacggcgacaccttctacaaccagaagttcaagggcaaagccacactgaccgtggacaagagcagcaacaccgcctacatgcagctcaactccctgaccagcgaggacagcgccgtgtactactgtgccagaaccggcagatacgaagagaacgctatggactactggggccagggcacaagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1298 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatccgtgtctgctgcccctggacagaaagtgaccatcagctgtagcggcagcagcagcaacatcggcaacaactacgtgtcctggtatcagcagctgcccggcacagctcccaaactgctgatctacgacaacaacaagcggcccagcggcatccccgatagattttctgccagcaagagcggcaccagcgccacactgggaatcacaggactccagaccagagatgaggccgactactactgcggcacctgggattcttctctgtccgcctgggttttcggcggaggcacaaaactgacagtgctcggaggcggaggcggaagtggaggcggaggatctggcggcggaggctctcaagttcagctggttcagtctggggccgaagtgaagaaacctggcagcagcgtgaaggtgtcctgcaaggcttccggcgataccttcagcagctactacatcagctgggtccgacaggccccaggacaaggacttgagtggatgggcagaatcatccccatcctgggaatcgccaactacgcccagaaataccagggcagagtgaccctgagcgccgacaagagcacaagcaccagctacatggaactgaacagcctgagcagcgaggacaccgccgtgtactattgtgccctggactggtcctacagcatcgactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1299 - DNA, 2748 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctatgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctctgtgtttggcacaggcacaaaggtgctggtgcttggcggaggcggaagtggaggcggaggatctggcggcggaggctctcaagttcagctggttcagagcggagccgaagtgaagaaacctggcagcagcgtgaaggtgtcctgcaaagcaagcggcggcaccttcagcagctacaccatcaacgtttggagacaggccccaggccagggccttgaatggatgggaggcttcatccctatcagcggcaccgtgaactacgcccagaaattccagggcagagtgacaatcaccgccgacgagagcacaagcaccgcctacatggaactgtccagcctgagaagcgaggacaccgccgtgtactactgtgccagacctctggattggaccgaggacatctggggccagggaacactggtcacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1300 - DNA, 2757 bp, Artificial Sequence
  Synthetic Polynucleotide encoding a CAR with optional accessory module(s)
atggccttaccagtgaccgccttgctcctgccgctggccttgctgctccacgccgccaggccgaacttcatgctgacccagcctcacagcgtgtccgagtctccaggcaagaccgtgaccatcagctgtacaggcagcagcggctctatcgccagcaactacgtgcagtggtatcagcagaggccaggcagcgcccctaccatcctgatctacgaggataacaagcggcctagcggcgtgcccgatagattttctggcagcatcgacagcagcagcaacagcgccagcctgacaatcagcggcctgaaaacaggcgacgaggccgactactactgccagagctacgacgacatcaaccactgggttttcggcggaggcaccaagctgacagttcttggaggcggaggcggaagtggaggcggaggatctggcggcggaggctctgaagttcagctggttcagagcggagccgaagtgaagaaacctggggcctctgtgaaggtgtcctgcaaggcttccggctacacctttaccgcctactacctgcactggctgagacaggctccaggccaaggactggaatggatgggctggatgaacaccaacaacggggccaccagatacgcccagaaattccaggacagagtgaccatgaccagagacaccagcatcaacaccgcctacatggaaatgagcggcctgtcctccgacgacaccgccatgtactattgtgccagaggcgacatcagccaggacttcgctgatgtgtggggccagggaacactggtcacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1301 - DNA, 2778 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggaggcggtggaagtggcggcggtggttcaggcggcggaggatctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1302 - DNA, 420 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagc

SEQ ID NO: 1303 - DNA, 417 bp, Artificial Sequence
  Synthetic Polynucleotide encoding a CAR with optional accessory module(s)
atggccttaccagtgaccgccttgctcctgccgctggccttgctgctccacgccgccaggccggaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctct

SEQ ID NO: 1304 - DNA, 819 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggaggactggtgcaggctggaagaagcctgagactgtcttgtgccgccagcgagcacacctttagctctcacgtgatgggctggttcagacaggcccctggcaaagaaagggaaagcgtggccgttatcggctggcgggatattagcaccagctacgccgatagcgtgaagggcagattcaccatcagccgggacaacgccaagaaaaccctgtacctccagatgaacagcctgaagccagaggacaccgccgtgtactactgcgccgccagaagaattgacgccgccgactttgattcttggggccagggaacccaagtgaccgtttctagcggaggcggtggaagtggcggcggtggttcaggcggcggaggatctgaagtgcaactggttgaatccggtggcggcctggtgcaagcaggcggatctctcagacttagctgtgccgcctccggcagaaccttcacaatgggatggtttaggcaggctccagggaaagagagagagttcgtcgccgccatctctctgtctcccacactggcctactacgccgagtctgtgaaaggccggttcaccatctccagagataatgccaagaacaccgtggtgctgcaaatgaactctctgaaacccgaggatacagccctgtactattgtgccgctgaccggaagtccgtgatgagcatcagacccgattactggggacagggcacacaagtcacagtgtcctct

SEQ ID NO: 1305 - DNA, 411 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagt

SEQ ID NO: 1306 - DNA, 429 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctct

SEQ ID NO: 1307 - DNA, 798 bp, Artificial Sequence
  Synthetic Polynucleotide encoding a CAR with optional accessory module(s)
atggccttaccagtgaccgccttgctcctgccgctggccttgctgctccacgccgccaggccggaggtgcaactggttgagtctggcggaggactggttcaggcaggcggatctctgagactgagctgtatcgccaccggcaaggtgttcagcatctacgacatgggctggtacagacaggcccctggcaagcagagagagctggttgccgagatcacaagcagcggcaccacacactacgacgacttcgtgtccggcagattcaccatcagccgggacaacgccaagaacaccgtgtacctccagatgaacaccctgaaggccgaggacaccgccgtgtactactgtagagccaaccacgtgttcggcggcagctattggggacagggaacccaagtgacagtgtctagtgaggtggccgctttggagaaacaggtgcagcttgttgaaagcggaggtggcctggttcaacctggcggaagcctgagactgtcctgtgaagccagcggctttaccctggactactacgccatcggctggtttagacaagctcccggcaaagagagagagggcgtcatctgcatcagcagatccgacggcagcacctactatgccgacagcgtgaagggacgcttcaccatctccagagacaatgccaaaaagacggtctacctgcaaatgatctccctcaagcctgaggataccgccgcctactattgtgccgctggcgctgattgcagcggctacctgagagactacgagttcagaggccagggcacacaagtgaccgtcagctct

SEQ ID NO: 1308 - DNA, 447 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagc

SEQ ID NO: 1309 - DNA, 420 bp, Artificial Sequence
  Synthetic Polynucleotide encoding a CAR with optional accessory module(s)
atggccttaccagtgaccgccttgctcctgccgctggccttgctgctccacgccgccaggccgcaagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagt

SEQ ID NO: 1310 - DNA, 825 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggcagactggtgcagcctagaggaagcctgagactgtcttgtgccggcagcggcagaacctttagcacatacggcatggcctggttcagacaggcccctggaaaagagagagagttcgtcgccagcaaggccagcatgaactactccggcaggacctactacgccgacagcgtgaagggcagattcacaatcgccagagacaacgccaagaacatggtgttcctccagatgaacaatctgaagcccgaggacaccgccgtgtactattgtgccgctggcacaggctgtagcacctacggctgtttcgacgcccagatcatcgactactggggcaagggcacactggtcacagtttctagcgaggtggccgctttggagaaacaagtcaaactggaagaaagcggtggcggcctggtgcaacctggcgaatctctgagactgagctgtagcgccagcggctccatcttcaaggtgttcagagtgttcgccatgagctggtacaggcaaggccctggcaagcagagagagctggtcgcctctatcagcagcggcgagacaaccacatacgccgactctgtgaaaggccggttcaccatcagccgggataatgccaagaataccgcctatctccagatggactccctgaagcctgaagatacagctgtgtactactgcaacgccgaccataccttcaccggcgatttttggggccagggaacccaagtgaccgtgtctagt

SEQ ID NO: 1311 - DNA, 414 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagt

SEQ ID NO: 1312 - DNA, 450 bp, Artificial Sequence
  Synthetic Polynucleotide encoding a CAR with optional accessory module(s)
atggccttaccagtgaccgccttgctcctgccgctggccttgctgctccacgccgccaggccgcctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctct

SEQ ID NO: 1313 - DNA, 846 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctggaagagtctggcggagagctggttcaacctggcggacctctgagactgtcttgtgccgccagcggcaacatcttcagcatcaaccggatgggctggtacagacaggcccctggaaaacagagagccttcgtcgcctctatcaccgtgcggggcatcaccaattacgccgactctgtgaagggcagattcaccatcagcgtggacaagagcaagaacaccatctacctccagatgaacgccctgaagcctgaggacaccgccgtgtactactgcaatgccgtgtccagcaacagggaccccgattattggggccagggcacccaagtgacagtgtctagtggaggcggtggaagtggcggcggtggttcaggcggcggaggatctcctgttcaactggttgaatctggcggcggactggtgcaggctggcgatagtctcagactgagctgtgccgcctccggcagaacatttggcatcggcacaatgggatggttccggcagcctcctggaaaagaacgcgaatttgtggccgccatcagatggtctacaggcggcaccagatacgccgacagcgtgaaaggccggtttaccatcagcagagacaacgccaagctgaccgtggatctccagatggatagcctgaaaccagaggatacagccgtctattactgcgccgctgacaggctgagcctggatctgtctggcagataccactacaaccctgccgtgtacgactactggggacagggaacacaagtcaccgtgtcctct

SEQ ID NO: 1314 - DNA, 420 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttct

SEQ ID NO: 1315 - DNA, 423 bp, Artificial Sequence
  Synthetic Polynucleotide encoding a CAR with optional accessory module(s)
atggccttaccagtgaccgccttgctcctgccgctggccttgctgctccacgccgccaggccgcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctct

SEQ ID NO: 1316 - DNA, 801 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctct

SEQ ID NO: 1317 - DNA, 885 bp, Artificial Sequence
  Synthetic Polynucleotide encoding a CAR with optional accessory module(s)
atggccttaccagtgaccgccttgctcctgccgctggccttgctgctccacgccgccaggccggccgtgcaactggttgaatctggcggaggactggtgcaggctggcgattctctgagactgacctgtacagccagcggcagagccttcagcacctacttcatggcctggttcagacaggcccctggcaaagagagagagttcgtcgccggaatcgcttggagcggaggctctacagcctacgccgattctgtgaagggcagattcaccatcagccgggacaacgccaagaacaccgtgtacctccagatgaacagcctgaagtccgaggacaccgccgtgtactactgtgccagcagaggcatcgaggtggaagagtttggagcctggggccagggaacccaagtgacagtttcttctcctggcggaggcgggtctcctcaggttcaactggtggaaagtggcggtggcttggtgcaagcaggcggctctcttagactgtcttgtgctgcctctggcggcaccctgagcaagaataccgtggcatggtttaggcaggctcccggaaaagagcggggctttgtcgccagcatcacctgggatggcagaaccacctactacgccgacagcgtgaaaggccggttcaccatctccagagataatgccaagaatacggtctacttgcaaatgaactccctgaagcctgaagatacagccgtgtacgtgtgcgccgatctcggcaaatggcctgctggacctgccgattattggggacagggcacacaagtcaccgtgtcctctgaggttgccgcactggagaaggaagtagccgcgcttgagaaagaggtggcagcgctggagaaagaagttgccgccttggaaaaa

SEQ ID NO: 1318 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1319 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1320 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1321 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1322 - DNA, 2199 bp, Artificial Sequence
  Synthetic Polynucleotide encoding a CAR with optional accessory module(s)
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1323 - DNA, 2196 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagaggcggaggcggaagtggaggcggaggatctggcggcggaggctctgaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1324 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccccgatttccagagcgtgacccctaaagaaaaagtgaccatcacctgtcgggccagcgagagcgtggacacattcggcatcagcttcatgaactggttccagcagaagcccgatcagagccccaagctgctgattcacgccgccagcaatcaaggcagcggagtgcctagcagattttccggctctggcagcggcaccgatttcaccctgaccatcaatagcctggaagccgaggatgccgccacctactactgccagcagagcaaagaggtgcccttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcagctcttggatgaactgggtccgacaggcccctggcaaaggactggaatgggtcggaagaatctaccccggcgacggcgacaccaactacaacggcaagttcaagggcagattcaccatcagccgggacgacagcaagaacagcctgtacctgcagatgaactccctgaaaaccgaggacaccgccgtgtactactgtgccagatccggcttcatcaccaccgtgctggacttcgattattggggccagggcaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1325 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggccattcagctcacacagagcccttctagcctgagcgcctctgtgggcgacagagtgaccatcacatgtagagccagccagggcatcagcagcgcccagcagaaacctggaaaggcccctaagctgctgatcctggcctggtacagcagcctggaaagcggagtgcctagcagattcagcggctacgatgcctctggcagcggcaccgatttcaccctgacaatatccagcctccagcctgaggacttcgccacctactactgccagcagttcaacagctacccctacaccttcggccagggcaccaagctggaaatcaaaggcggaggcggaagtggaggcggaggatctggcggcggaggctctgaagtgcaactggttcagagcggagccgaagtgaagaagcctggcgagagcctgaagattagctgcaaaggctccggctacagcttcagcagctcttggatcggctgggtccgacagatgcctggcaaaggactggaatggatgggcatcatctaccccgacgacagcgacaccagatacagccctagcttccagggccaagtgacaatcagcgccgacaagagcatcagaaccgcctacctccagtggtcctctctgaaggccagcgataccgccatgtactactgcgccagacacgtgaccatgatctggggagtgattatcgacttctggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1326 - DNA, 2250 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1327 - DNA, 2196 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggactacgacggcgacagctacctgaactggtatcagcagaagcccggccagcctcctaagctgctgatctacgatgccagcaacctggtgtctggcatccctcctagattttccggcagcggctctggcaccgatttcaccctgaccatcagcagactggaacccgaggacttcgccgtgtaccactgtcagcagagcacagaggacccctggacatttggcggaggcaccaagctggaaatcaaaggcggaggcggaagtggaggcggaggatctggcggcggaggctctcaggtgcagctggttgaatctggcggcggacttgttgagcctggcggatctctgagactgagctgcatgagcggctacgccttcagcagctactggatgaactgggtccgacagatgcccggcaaaggactggaatggatgggccagatttggcctggcgacggcgataccaactacaaccccagcctgaagtccagagtgaccatcaccgccgatgagagcaccagcaccgcctacatggaactgtctagcctgaaggccgaggatacagccgtgtacttctgcgccagacgggaaaccacaaccgtgggcagatattactacgctatggactactggggccagggcaccctggttacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1328 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggacaactacggcatcagcttcatgaactggtatcagcagaagcccggccagcctcctaagctgctgatctacgccgccagcaatcaaggctctggcatccccagcagattttccggctctggaagcggcaccgacttcaccctgaccataagcagcctggaacctgaggacttcgccatgtacttttgccagcagagcaacgaggtgcccagaacctttggcggaggcaccaagctggaaatcaaaggcggaggcggaagtggaggcggaggatctggcggcggaggctctcaggtgcaactggttgagtctggcggcggacttgttgaacctggcggaagcctgagactgagctgcatgagcggctacgcctttagcagctcctggatgaactgggtccgacagatgcctggcaaaggactggaatggatgggcagaatctaccccggcgacggcgacaccaactacaacggcaagttcaaagaacgggtcaccatcaccgccgacgagagcacaagcaccgcctacatggaactgagcagcctgaaggccgaggataccgccgtgtacttctgcgccagaagcgagtattggggcaactactgggctatggactactggggccagggcacactggtcacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1329 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgcaaggccagtcagaacgtgggcacaaacgtggcctggtatcagcagaagcctggacagcctcctaagctgctgatctacagcgccacctaccggaactctggcatccctgccagattttctggcagcggctctggcaccgagttcaccctgaccatcaccaacgtgcagagcaaggacctggccgactacttctacttctgccagtacaacagatacccctacaccagcggcggaggcaccaagctggaaatcaaaagaggcggaggcggaagtggaggcggaggatctggcggcggaggctctcaggtgcaactggttgaatcaggcggaggactggtggaacctggcggatctctgagactgagctgtatgagcggctacgccttcagcagctactggatgaactgggtccgacagatgcccggcaaaggactggaatggatgggccaaatctaccccggcgacggcgacaccaactacaacggcaagttcaagggcagagtgacaatcaccgccgacgagagcacaagcaccgcctacatggaactgagcagcctgaaggccgaggataccgccgtgtacttctgcgccagaaagaccatcagcagcgtggtggatttctacttcgacaactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1330 - DNA, 2223 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattccagatcgtgctgacacagtctccagccacactgagcgcttctccaggcgagaaggccaccatgacatgttctgccagcagcggcgtgaactacatgcactggtatcagcagaagcccggcacaagccccaagcggtggatctacgataccgacaagacagccagcggagtgcccgccagattttctggctctggcagcggcacatcctacagcctgacaatcagcagcatggaagccgaggatgccgccacctactactgtcaccagagaggcagctacaccttcggcggaggcaccaagctggaaatcaaaggcggaggcggaagtggaggcggaggatctggcggcggaggctctcaagttcagctggaacaacctggcgctgaggtggtcaaaccaggggcctctgtgaaggtgtcctgcaagacaagcggctacacattcaccagcaactggatgcactgggtcaagcagacccctggcaaaggactggaatggatcggcgagatcgaccccagcgactcctacaccaactacaaccagaagttcgacggcaaggccaagctgaccgtggacaagtctagcagcaccgcctacatggaagtgtccgatctgaccgccgaagatagcgccacatattactgcgccagaggcagcaacccctactactacgctatggactattggggccagggcaccagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1331 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1332 - DNA, 2205 bp, Artificial Sequence
  Synthetic Polynucleotide encoding a CAR with optional accessory module(s)
atggccttaccagtgaccgccttgctcctgccgctggccttgctgctccacgccgccaggccggacgacatccagctgacccagagccccagcagcctgagcgccagcgtgggcgacagagtgaccatcacctgcaaggccagccagagcgtggactacgacggcgacagctacctgaactggtaccagcagatccccggcaaggcccccaagctgctgatctacgacgccagcaacctggtgagcggcatcccccccagattcagcggcagcggcagcggcaccgactacaccttcaccatcagcagcctgcagcccgaggacatcgccacctaccactgccagcagagcaccgaggacccctggaccttcggcggcggcaccaagctgcagatcaagagaggcggaggcggaagtggaggcggaggatctggcggcggaggctctcaggtgcagctgcagcagagcggcgccgaggtgaagaagcccggcagcagcgtgaaggtgagctgcaaggccagcggctacgccttcagcagctactggatgaactgggtgagacagagacccggccagggcctggagtggatcggccagatttggcccggcgacggcgacaccaactacaacggcaagttcaagggcagagccaccatcaccgccgacgagagcaccaacaccgcctacatggagctgagcagcctgagaagcgaggacaccgccttctacagctgcgccagaagagagaccaccaccgtgggcagatactactacgctatggactactggggccagggcaccaccgtgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1333 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1334 - DNA, 2196 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1335 - DNA, 2211 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1336 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1337 - DNA, 2202 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1338 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1339 - DNA, 2196 bp, Artificial Sequence
  Synthetic Polynucleotide encoding a CAR with optional accessory module(s)
atgaggctccctgctcagctcctggggctgctaatgctctgggtctctggaagcagtggggatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaaggcggaggcggaagtggaggcggaggatctggcggcggaggctctgaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1340 - DNA, 2271 bp, Artificial Sequence
  Synthetic Polynucleotide encoding a CAR with optional accessory module(s)
atggccttaccagtgaccgccttgctcctgccgctggccttgctgctccacgccgccaggccggccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1341 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1342 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1343 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1344 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1345 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1346 - DNA, 2211 bp, Artificial Sequence
  Synthetic Polynucleotide encoding a CAR with optional accessory module(s)
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1347 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1348 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1349 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1350 - DNA, 2556 bp, Artificial Sequence
  Synthetic Polynucleotide encoding a CAR with optional accessory module(s)
atggttaggggcgttccattcagacatctgcttctggtcttgcagcttgcactcttgcccgctgccacccagggcaaaaaagtggtgctgggcaagaaaggcgacaccgtggaactgacctgcaccgccagccagaagaagtccatccagttccactggaagaacagcaaccagatcaagatcctgggcaaccagggcagcttcctgaccaagggacccagcaagctgaacgacagagccgacagcagacggtccctgtgggaccagggcaatttcccactgattatcaagaacctgaagatcgaggacagcgacacctacatctgcgaggtggaagatcagaaagaagaggtgcaactgctggtgttcggcctgaccgccaactccgacacccatctgctccagggccagagcctgaccctgacactggaaagccctccaggcagctcccccagcgtgcagtgtagaagcccacgaggcaagaacatccagggaggcaaaacattgtcagtgtcccaactggaactccaggactccggcacctggacctgtaccgtgctccagaaccagaaaaaggtggagttcaagatcgacatcgtggtgctggccttccagaaagcctctggcggaggcggaagtggaggcggaggatctggcggcggaggctctatctaccaggaactgacacaactgaaggccgccgtggaacggctgtgccacccttgtccttgggagtggaccttctttcagggcaactgctacttcatgagcaacagccagcggaactggcacgacagcatcaccgcctgcaaagaagtgggagcccaactggtcgtgattaagagcgccgaggaacagaacttcctccaactccagagcagcagaagcaacagattcacctggatgggcctgagcgacctgaaccaggaaggcacctggcagtgggtggacggatctcctctgctgcccagcttcaagcagtattggaaccggggcgagcccaacaacgtgggcgaagaggattgcgccgagttcagcggcaacggctggaacgacgacaagtgcaacctggctaagttctggatctgcaagaagtccgccgcctcctgtagccgggatgaggaacagttcctgagccctgcccctgccacccctaatcctccaccagctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1351 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1352 - DNA, 2184 bp, Artificial Sequence; identical to SEQ ID NO: 1351
  Synthetic Polynucleotide encoding a CAR with optional accessory module(s)

SEQ ID NO: 1353 - DNA, 2025 bp, Artificial Sequence
  Synthetic Polynucleotide encoding a CAR with optional accessory module(s)
atggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1354 - DNA, 2025 bp, Artificial Sequence
  Synthetic Polynucleotide encoding a CAR with optional accessory module(s)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1355 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1356 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1357 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1358 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1359 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1360 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1361 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgatagagtgaccatgacctgtagagccagcagcagcgtgtcctacatccactggttccagcagaagcctggcaaggcccctaagccttggatctacgccaccagcaatctggcctctggcgtgccagtcagattttctggcagcggctctggcaccgactacaccttcacaatatccagcctccagcctgaggacattgccacctactactgccagcagtggacctccaatcctcctacctttggcggaggcaccaagctggaaatcaaaggcggaggcggaagtggaggcggaggatctggcggcggaggctctcaggttcagctccagcagtctggggccgaagtgaagaaacctggcagctccgtgaaagtgtcctgcaaggccagcggctacacctttaccagctacaacatgcactgggtcaagcaggcccctggacagggactcgaatggatcggagccatctatcccggcaacggcgacacctcctacaaccagaagttcaagggcaaagccacactgaccgccgacgagagcacaaacaccgcctacatggaactgagcagcctgagaagcgaggacaccgccttctactactgtgcccggtctacctactacggcggcgactggtactttgacgtgtggggccagggaaccaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1362 - DNA, 2211 bp, Artificial Sequence
  Synthetic Polynucleotide encoding a CAR with optional accessory module(s)
atggccttaccagtgaccgccttgctcctgccgctggccttgctgctccacgccgccaggccgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1363 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1364 - DNA, 2181 bp, Artificial Sequence; identical to SEQ ID NO: 1360
  Synthetic Polynucleotide encoding a CAR with optional accessory module(s)

SEQ ID NO: 1365 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1366 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1367 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1368 - DNA, 2193 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1369 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1370 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1371 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1372 - DNA, 2166 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1373 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1374 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1375 - DNA, 2202 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1376 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1377 - DNA, 2268 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1378 - DNA, 2265 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1379 - DNA, 2313 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1380 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1381 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1382 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1383 - DNA, 2199 bp, Artificial Sequence
  Synthetic Polynucleotide encoding a CAR with optional accessory module(s)
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1384 - DNA, 2160 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1385 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1386 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1387 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1388 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1389 - DNA, 2196 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1390 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1391 - DNA, 2193 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1392 - DNA, 2193 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1393 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1394 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1395 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1396 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1397 - DNA, 2163 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1398 - DNA, 2256 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1399 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1400 - DNA, 2196 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1401 - DNA, 2208 bp, Artificial Sequence
  Synthetic Polynucleotide encoding a CAR with optional accessory module(s)
atggccttaccagtgaccgccttgctcctgccgctggccttgctgctccacgccgccaggccggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1402 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1403 - DNA, 2166 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1404 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1405 - DNA, 2160 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1406 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1407 - DNA, 2166 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1408 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1409 - DNA, 2205 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1410 - DNA, 2196 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1411 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1412 - DNA, 2151 bp, Artificial Sequence
  Synthetic Polynucleotide encoding a CAR with optional accessory module(s)
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1413 - DNA, 2166 bp, Artificial Sequence
  Synthetic Polynucleotide encoding a CAR with optional accessory module(s)
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1414 - DNA, 2202 bp, Artificial Sequence
  Synthetic Polynucleotide encoding a CAR with optional accessory module(s)
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1415 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1416 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1417 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1418 - DNA, 2193 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1419 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1420 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1421 - DNA, 2223 bp, Artificial Sequence
  Synthetic Polynucleotide encoding a CAR with optional accessory module(s)
atggccttaccagtgaccgccttgctcctgccgctggccttgctgctccacgccgccaggccggacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctggcggaggcggaagtggaggcggaggatctggcggcggaggctctcaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1422 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1423 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1424 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1425 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1426 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1427 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1428 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1429 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1430 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1431 - DNA, 2193 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1432 - DNA, 2193 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1433 - DNA, 2226 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgagggcggaggcggaagtggaggcggaggatctggcggcggaggctctttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1434 - DNA, 2328 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagtctcgagggaggaggcggctccgggggaggcggaagtggaggcggaggatctgggtctggaggaagcggatctggaggctcagggtcagggggctcaggcagtggaggctctttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1435 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1436 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1437 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacagcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccggcggaggcggaagtggaggcggaggatctggcggcggaggctctgaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1438 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgggcggaggcggaagtggaggcggaggatctggcggcggaggctctgacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1439 - DNA, 1830 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1440 - DNA, 2256 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagggcggaggcggaagtggaggcggaggatctggcggcggaggctctttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1441 - DNA, 2313 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagggaggaggcggctccgggggaggcggaagtggaggcggaggatctgggtctggaggaagcggatctggaggctcagggtcagggggctcaggcagtggaggctctttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1442 - DNA, 2157 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1443 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1444 - DNA, 2196 bp, Artificial Sequence
  Synthetic Polynucleotide encoding a CAR with optional accessory module(s)
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1445 - DNA, 2199 bp, Artificial Sequence
  Synthetic Polynucleotide encoding a CAR with optional accessory module(s)
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1446 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1447 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1448 - DNA, 2214 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1449 - DNA, 2202 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1450 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaaggcggaggcggaagtggaggcggaggatctggcggcggaggctctcaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1451 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1452 - DNA, 2103 bp, Artificial Sequence
  Synthetic Polynucleotide encoding a CAR with optional accessory module(s)
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1453 - DNA, 2196 bp, Artificial Sequence
  Synthetic Polynucleotide encoding a CAR with optional accessory module(s)
atggccttaccagtgaccgccttgctcctgccgctggccttgctgctccacgccgccaggccggacctggaaaccaccctgacacagagccctgccaccctgagtgtgtccccaggcgagagagtgaccctgagctgtagagccagccagagcgtgggcagcaacctggcctggtatcagcagaagttcggccaggcccccagactgctgatctacgacgccagcacaagagccaccggcatccccgccagattttctggcagcggctccggcaccgagttcaccctgaccatcagcagactggaacccgaggacttcgccgtgtactactgccaccagtacggcagcagccccagaacctttggacagggcaccaaggtggacatcaagcggggcggaggcggaagtggaggcggaggatctggcggcggaggctctcaggtgcaactggtgcagagcggagccgaagtgaagaaacctggggccagcgtgaaggtgtcctgcaaggccagcggctacacctttaccacctacggcatctcttgggtgcgccaggctcctggacagggactggaatggatgggctggatcagcgcctacaacggccacaccaactacgcccagatgctccagggcagagtgaccatgaccaccgacaccagcacctccaccgcctacatggaactgcggggcctgagaagcgacgacaccgccgtgtattattgcgccagagaagcctacgcctcctacggcagcggcagctactggaccgattattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1454 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1455 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1456 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1457 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1458 - DNA, 2196 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1459 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1460 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1461 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1462 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1463 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1464 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1465 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacaacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagagaggcggaggcggaagtggaggcggaggatctggcggcggaggctctcaagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1466 - DNA, 2205 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacagggcggaggcggaagtggaggcggaggatctggcggcggaggctctgaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1467 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1468 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1469 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgctgacccagagccccgccagcctggccgtgagcctgggccagagcgtgaccatcagctgcagagccagcgagagcgtggagtactacggcaccagcctgatgcagtggtaccagcagaagcccggccagccccccaagctgctgatctacgccaccagcaacgtggagagcggcgtgcccgccagattcagcggcagcggcagcggcaccgacttcagcctgaacatccaccccgtggaggaggacgacatcgccatgtacttctgccagcagagcagaaagctgcccagcaccttcggcggcggcaccaagctggagatcaagggcggaggcggaagtggaggcggaggatctggcggcggaggctctgacgtgagactgcaggagagcggccccggccaggtgaagcccagccagaccgtgagcctgacctgcagcgtgaccggctacagcatcaccaacggcaaccactggtggaactggatcagacaggtgagcggcagcaagctggagtggatcggctacatcagcagcagcggcagcaccgacagcaaccccagcctgaagagcagaatcagcatcaccagagacaccagcaagaaccagctgttcctgcagctgaacagcgtgaccaccgaggacatcgccacctactactgcgccagaggctactacttcgactactggggccagggcaccaccctgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1470 - DNA, 1812 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1471 - DNA, 1617 bp, Artificial Sequence
  Synthetic Polynucleotide encoding a CAR with optional accessory module(s)
atggactggatttggcgcatccttttccttgtcggcgctgctaccggcgcccattccttcgaaggcagcggattcgaatacgccaaagagatgcggaacgcctactgggagatcgccctgctgcccaatctgaccaaccagcagaagagagcccccatcagaaagctgtacgacgacccctcccagagcagcgagctgctgtctgaggctaaaaaactgaacgatagccagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1472 - DNA, 1830 bp, Artificial Sequence
  Synthetic Polynucleotide encoding a CAR with optional accessory module(s)
atggccctgcccgtgacagccctgctgctgcctctggctctgctgctgcacgccgccagacccgatgaattcggctctgacctgggcatcaagctgctgttcgccgctgccaagggccaggacgacgaagtgcggattctgctggctgctggggccgacgtgaacgccaaggatttcgagggctacacccccctgcacgtggccgcctatgatggacacctggaaatcgtggaagtgctgctgaaggctggcgctgatgtgaatgccaaagacagccagggccggacccctctgcatgaagccgcctacagcggccatctggaaattgtggaagtgctgctgaaagccggggcagacgtgaacgctcaggacgacgctggcgagacaccagccgatctggctgcagcttggggccacgaagatatcgccgaggtgctgcagaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1473 - DNA, 1827 bp, Artificial Sequence
  Synthetic Polynucleotide encoding a CAR with optional accessory module(s)
atggactggatttggcgcatccttttccttgtcggcgctgctaccggcgcccattccttcgaaagaagcgatctgggaaagaagctgctggaagctgccagagccggacaggatgatgaagtgcgcatcctgatggcaaacggcgcagatgtgaacgcaaaggacgagtacggcctgacccccctgtacctggctacagcccacgggcacctggaaattgtggaagtgctgctgaagaacggcgctgacgtgaacgccgtggacgccatcggctttaccccactgcatctggccgctttcatcgggcatctcgaaatcgcagaggtgctgctgaaacacggggccgatgtgaatgcccaggacaagttcggcaagaccgccttcgacatcagcatcggcaacggcaacgaggacctggccgagatcctgcagaaactgaacacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1474 - DNA, 2283 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgagggaggaggcggctccgggggaggcggaagtggaggcggaggatctgggtctggaggaagcggatctggaggctcagggtcagggggctcaggcagtggaggctctttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1475 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1476 - DNA, 1812 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1477 - DNA, 1632 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgtggacaacaagttcaacaaagagcggtacagcgcctactacgagatttggcaactgcccaacctgaacgtgcggcagaaggccgccttcatcggatctctgcaggacgaccctagccagagcgccaatctgctggccgaggccaagaagctgaacgacgcccaggcccctaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1478 - DNA, 2298 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgagggaggaggcggctccgggggaggcggaagtggaggcggaggatctgggtctggaggaagcggatctggaggctcagggtcagggggctcaggcagtggaggctctttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1479 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1480 - DNA, 2196 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1481 - DNA, 2214 bp, Artificial Sequence
  Synthetic Polynucleotide encoding a CAR with optional accessory module(s)
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1482 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1483 - DNA, 2199 bp, Artificial Sequence
  Synthetic Polynucleotide encoding a CAR with optional accessory module(s)
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1484 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1485 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagagaggcggaggcggaagtggaggcggaggatctggcggcggaggctctgaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1486 - DNA, 2199 bp, Artificial Sequence
  Synthetic Polynucleotide encoding a CAR with optional accessory module(s)
atggccttaccagtgaccgccttgctcctgccgctggccttgctgctccacgccgccaggccgagctacgagctgacacagcctccatccgtgtctggcacacctggacagagagtggctatctcctgtagcggcagcagcagcaacatcggcaccagaatggtcacctggtatcagcacgtgccaggcacagcccctaagctgctgatcttcaacaacaaccagcggcctagcggcgtgcccgatagattttctgccagcaagagcggcacaagcgccagcctggctatcatcggactccagtctgacgacgaggccgactactactgtgccacctgggacgacaacgtgaagtcctacgtgttcggcaccggcaccaaagtgacagtgcttggaagtagaggcggaggcggaagtggaggcggaggatctggcggcggaggctctcttgaaatggcccaggttcagctccagcagtggggagctggactgctgaagcctagcgagacactgagcctgacctgtgctgtgtacggcggcagcttcagcggctactactggtcctggatcagacagcctcctggcaaaggactggaatggatcggcgagatcaaccacagcggctccaccaactacaaccccagcctgaagtccagagtgaccatcagcgtggacaccagcaagaaccagttctccctgaagctgagcagcgtgacagccgctgataccgccgtgtactattgcgctagagcccctcagtcttggtacgtgggagatgtgtggggccagggcacactggttacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1487 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagcctgtctgtggcccctggaaagacagccagcatcacatgcggcggcaacaacatcggcatgaagtccgtgcactggtatcagcagaggccaggacaggctcctgtgctggtcatctactacgacagcgacagaccctctggcatccccggcagattttccggcagcaactctggcaataccgccacactgaccatctccagagtggaagctggcgacgaggccgactactactgccaagtgtgggataccaccggcgatcaccctggctatgtgtttggcaccggcaccaaagtgacagtgcttggcggaggcggaagtggaggcggaggatctggcggcggaggctctcaagttcaactggttcagagcggagccgaagtgaagaaacctggcagcagcgtgaaggtgtcctgcaaagcaagcggcggcacctttagcagctacgccatctcttgggtccgacaggcacctggacaaggactggaatggatgggcggcatcatccccatcttcggcacagccaattacgcccagaaattccagggcagagtgaccatcaccgccgacgagtctacaagcaccgcctacatggaactgagcagcctgagaagcgaggacaccgccgtgtactattgtgccagaggcgtgtacggctacagcggctctgccccttatgatgagtggggccagggaaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1488 - DNA, 2208 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcggggcggaggcggaagtggaggcggaggatctggcggcggaggctctcaggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1489 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagagaggcggaggcggaagtggaggcggaggatctggcggcggaggctctgaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1490 - DNA, 2139 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1491 - DNA, 1806 bp, Artificial Sequence
  Synthetic Polynucleotide encoding a CAR with optional accessory module(s)
atggactggatttggcgcatccttttccttgtcggcgctgctaccggcgcccattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1492 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1493 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1494 - DNA, 2199 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagggcggaggcggaagtggaggcggaggatctggcggcggaggctctcagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1495 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1496 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1497 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1498 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1499 - DNA, 2130 bp, Artificial Sequence
  Synthetic Polynucleotide encoding a CAR with optional accessory module(s)
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttcttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1500 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1501 - DNA, 2196 bp, Artificial Sequence
  Synthetic Polynucleotide encoding a CAR with optional accessory module(s)
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1502 - DNA, 2184 bp, Artificial Sequence; identical to SEQ ID NO: 1387
  Synthetic Polynucleotide encoding a CAR with optional accessory module(s)

SEQ ID NO: 1503 - DNA, 2202 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaagggcggaggcggaagtggaggcggaggatctggcggcggaggctctgaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1504 - DNA, 2193 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaagggcggaggcggaagtggaggcggaggatctggcggcggaggctctcaactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1505 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1506 - DNA, 1833 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1507 - DNA, 2322 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcctcgagggaggtagcggctccgggggaggcggaagtggaggcggaggatctgggtctggaggaagcggatctggaggctcagggtcagggggctcaggcagtggaggctctttcgaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1508 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1509 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1510 - DNA, 2169 bp, Artificial Sequence
  Synthetic Polynucleotide encoding a CAR with optional accessory module(s)
atggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1511 - DNA, 2172 bp, Artificial Sequence
  Synthetic Polynucleotide encoding a CAR with optional accessory module(s)
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1512 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaaggcggaggcggaagtggaggcggaggatctggcggcggaggctctcaggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1513 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaagggcggaggcggaagtggaggcggaggatctggcggcggaggctctgaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1514 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggaccaggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagcggcggaggcggaagtggaggcggaggatctggcggcggaggctcttcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1515 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaaggcggaggcggaagtggaggcggaggatctggcggcggaggctctcaggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1516 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1517 - DNA, 2193 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1518 - DNA, 2199 bp, Artificial Sequence
  Synthetic Polynucleotide encoding a CAR with optional accessory module(s)
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1519 - DNA, 2196 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1520 - DNA, 1884 bp, Artificial Sequence
  Synthetic Polynucleotide encoding a CAR with optional accessory module(s)
atggccttaccagtgaccgccttgctcctgccgctggccttgctgctccacgccgccaggccgctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtgggcggaggcggaagtggaggcggaggagacacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1521 - DNA, 2166 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1522 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1523 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctttcgaagtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1524 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctgaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1525 - DNA, 1887 bp, Artificial Sequence
  Synthetic Polynucleotide encoding a CAR with optional accessory module(s)
atggccttaccagtgaccgccttgctcctgccgctggccttgctgctccacgccgccaggccgggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1526 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1527 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1528 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1529 - DNA, 2226 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1530 - DNA, 2217 bp, Artificial Sequence
  Synthetic Polynucleotide encoding a CAR with optional accessory module(s)
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1531 - DNA, 2139 bp, Artificial Sequence
  Synthetic Polynucleotide encoding a CAR with optional accessory module(s)
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1532 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1533 - DNA, 2160 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1534 - DNA, 2163 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1535 - DNA, 2163 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1536 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaaggcggaggcggaagtggaggcggaggatctggcggcggaggctctgaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1537 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacgacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaaggcggaggcggaagtggaggcggaggatctggcggcggaggctctgaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1538 - DNA, 2271 bp, Artificial Sequence
  Synthetic Polynucleotide encoding a CAR with optional accessory module(s)
atggccttaccagtgaccgccttgctcctgccgctggccttgctgctccacgccgccaggccggacgaattccaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggaggaggcggctccgggggaggcggaagtggaggcggaggatctgggtctggaggaagcggatctggaggctcagggtcagggggctcaggcagtggaggcagcttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1539 - DNA, 2196 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1540 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1541 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1542 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1543 - DNA, 2208 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1544 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1545 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1546 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1547 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaagaggcggaggcggaagtggaggcggaggatctggcggcggaggctctcaggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1548 - DNA, 2193 bp, Artificial Sequence
  Synthetic Polynucleotide encoding a CAR with optional accessory module(s)
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagagaggcggaggcggaagtggaggcggaggatctggcggcggaggctctcaggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1549 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1550 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1551 - DNA, 2205 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1552 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1553 - DNA, 2166 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1554 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1555 - DNA, 1947 bp, Artificial Sequence
  Synthetic Polynucleotide encoding a CAR with optional accessory module(s)
atggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggaccctaatgccatcttcctgagcttccaacacctgctccgaggaaaggtgcgtttcctgatgcttgtaggagggtccaccctctgcgtcaggcgggccccacccaccacagctgtccccagcagaacctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1556 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1557 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1558 - DNA, 2121 bp, Artificial Sequence
  Synthetic Polynucleotide encoding a CAR with optional accessory module(s)
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1559 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1560 - DNA, 2166 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1561 - DNA, 2199 bp, Artificial Sequence
  Synthetic Polynucleotide encoding a CAR with optional accessory module(s)
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1562 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1563 - DNA, 2199 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcggggcggaggcggaagtggaggcggaggatctggcggcggaggctctgaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1564 - DNA, 2193 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcggggcggaggcggaagtggaggcggaggatctggcggcggaggctctcaactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1565 - DNA, 2202 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagagaggcggaggcggaagtggaggcggaggatctggcggcggaggctctgaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1566 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1567 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggaccagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtggcggaggcggaagtggaggcggaggatctggcggcggaggctctcaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1568 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1569 - DNA, 2223 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1570 - DNA, 2205 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1571 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1572 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1573 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1574 - DNA, 2151 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1575 - DNA, 2160 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1576 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1577 - DNA, 2193 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagagaggcggaggcggaagtggaggcggaggatctggcggcggaggctctgaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1578 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1579 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1580 - DNA, 2175 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1581 - DNA, 2190 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagaggcggaggcggaagtggaggcggaggatctggcggcggaggctctcaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1582 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1583 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgtactggtatcagcagaagcccggacaggcccctagactgctgatctacagaaccagcaacctggcctctggcatccccgccagattttctggctctggcagcggcaccgatttcaccctgaccataagcagcctggaacctgaggacttcgccgtgtactactgccagcagtaccacagctaccccaccacctttggacagggcaccaaggtggaaatcaagcggacagttggcggaggcggaagtggaggcggaggatctggcggcggaggctctgaagtgcagctggttgaatcaggtggcggcctggttcaacctggcggatctctgagactgtcttgtgccgccagcggcttcagcttcaacacctacgccatgaactgggtccgacaggctcctggcaaaggactggaatgggtgtcccacatcagaagcaagagcaacaacttcgccacctactacgccgacagcgtgaaggacagattcaccatcagccgggacaacgccaagaacagcctgtacctccagatgaactccctgagagccgaggacaccgccgtgtattattgcgccagacaaggcggcgacttccctatggattattggggccagggcaccctggtcaccgtttcttctacgcgtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1584 - DNA, 2169 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1585 - DNA, 1506 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacatgtagagccagccaggacatcagcaagtacctgaactggtatcagcagaagcccggcaaggcccctaagctgctgatctaccacaccagcagactgcacagcggcgtgccaagcagattttctggcagcggctctggcaccgacttcaccctgacaatatccagcctccagcctgaggacttcgccacctactattgccagcagggcaacaccctgccttacacctttggcggcggaacaaaggtggaaatcaaaggcggaggcggaagtggaggcggaggatctggcggcggaggctctcaagttcagctgcaagagtctggccctggcctggtcaagcctagccaaacactgagcctgacctgtaccgtcagcggagtgtccctgcctgattatggcgtgtcctggatcagacagcctcctggcaaaggactggaatggatcggcgtgatctggggcagcgagacaacctactacaacagcgccctgaagtccagagtgctgatctccgtggacaccagcaagaaccaggtgtccctgaagctgagcagcgtgacagccgctgataccgccgtgtactactgcgccagacactactactacggcggcagctacgctatggactattggggccagggcaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1586 - DNA, 1527 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtccatctacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcctcctttcacattcggccctggcaccaaggtggacatcaaaggcggaggcggaagtggaggcggaggatctggcggcggaggctctcaggtgcagcttgttgaaagcggaggcggagttgtgcagcctggcagaagtctgagactgtcttgtgccgccagcggcttcaccttcagcagctatggaatgcactgggtccgacaggcccctggcaaaggacttgaatgggttgccgtgatctgggacgacggcagcaacaagtattacgtggacagcgtgaagggcagattcaccatcagccgggacaacagcaagaacaccctgtacctccagatgaacagcctgagagccgaggacacagccgtgtattattgcgccagagatgactactacggcagcggctccttcaacagctactatggcacagacgtgtggggccagggcacaacagttaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1587 - DNA, 1482 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctgaagtgcaactggttcaatctggcggcggactggttcatccaggcggttctctgagactgagctgtgccggctctggcttcaccttcagcacctacctgatgtactgggtccgacaggcccctggcaagacactggaatgggtgtccgctattggcagcggaggcgatacctactacgccgactctgtgaagggcagattcaccatcagccgggacaacgccaagaacagcctgtacctccagatgaactccctgagagccgaggacatggccgtgtactactgtgccagaggactcggctattggggccagggaacactggtcacagtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1588 - DNA, 1494 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccatcatgtccgcttctcccggcgagaaagtgaccatcacatgtagcgccagcagcagcgtgtcctacatgcactggttccagcagaagcccggcacaagccctaagctgtggatctacagcaccagcaatctggcctctggcgtgccagccagattttctggctctggcagcggcaccagctacagcctgacaatcagcagaatggaagccgaggacgccgccacctactactgtcagcagagaagcagctaccctcctacctttggcggaggcaccaagctggaaatcaaaggcggaggcggaagtggaggcggaggatctggcggcggaggctctcaggttcagctccagcagagcggagccgagcttatgaagcctggcgcttccgtgaagatcagctgcaaggccaccggctacaccttcagcagctactggatcgagtgggtcaagcagaggcccggacatggcctggaatggatcggagagatcctgcctggaagcggcagcaccaactacaacgagaagttcaagggcaaagccaccttcaccgccgacaccagcagcaacacagcctatatgcagctgagcagcctgaccagcgaggacagcgccgtgtactactgcgccagatacgactacccttggtttgcctattggggccagggcaccctggttacagtttctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1589 - DNA, 1518 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagccctagcagcctgacagtgacagccggcgagaaagtgaccatgagctgcaagagcagccagagcctgctgaacagcggcaaccagaagaactacctgacctggtatcagcagaagcccggccagcctcctaagctgctgatctactgggccagcaccagagaaagcggcgtgcccgatagattcacaggcagcggcagcggaaccgacttcaccctgacaatcagctctgtgcaggccgaggatctggccgtgtactactgccagaacgactacagctaccccttcacctttggctccggcaccaagctggaaatcaaaggcggaggcggaagtggaggcggaggatctggcggcggaggctctcaagttcagctgcaacagcctggggccgaactcgttagacctggcgcttctgtgaagctgtcctgcaaggccagcggctacacctttaccagctactggatcaactgggtcaagcagcggcctggacagggcctcgaatggatcggcaatatctaccccagcgacagctacaccaactacaatcagaagttcaaggacaaggccacactgaccgtggacaagtctagcagcaccgcctacatgcagctgagcagccctacaagcgaggacagcgccgtgtattattgcacccggtcttggcggggcaacagcttcgattattggggccagggcacaaccctgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1590 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1591 - DNA, 2184 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1592 - DNA, 2178 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1593 - DNA, 1527 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagccctagcagcctggctatgagcgtgggccagaaagtgaccatgacctgcaagagcagccagagcctgctgaacagcagcaaccagaagaactacctggcctggtatcagcagaagcccggacagtctcctaagctgctggtgtactttgccagcaccagagaaagcggcgtgcccgacagattcatcggctctggaagcggcaccgacttcaccctgacaatcagctctgtgcaggccgaggacctggccgattacttctgtcaccagcactacagcacccctctgacctttggagccggcaccaagctggaactgaaaggcggaggcggaagtggaggcggaggatctggcggcggaggctctgaagttcagctccagcagagcggccctgaccttgtgaaacctggcgcttccgtgaagatgagctgcaaggccagcggctacaccttcaccagctacgtgatgcactgggtcaagcagaaacccggccagggccttgagtggatcggctacatctacccctacaacgatggcaccaagtacaacgagaagttcaagggcaaagccacactgaccagcgacaagtctagcagcaccgcctacatggaactgagcagcctgacctctgaggacagcgccgtgtactactgcgccagagaggaatacggcaactacgtgcggtacttcgacgtgtggggagccggaacaaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1594 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1595 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1596 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1597 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1598 - DNA, 3462 bp, Artificial Sequence
  Synthetic Polynucleotide encoding a CAR with optional accessory module(s)
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1599 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagaggcggaggcggaagtggaggcggaggatctggcggcggaggctctgaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1600 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccccgatttccagagcgtgacccctaaagaaaaagtgaccatcacctgtcgggccagcgagagcgtggacacattcggcatcagcttcatgaactggttccagcagaagcccgatcagagccccaagctgctgattcacgccgccagcaatcaaggcagcggagtgcctagcagattttccggctctggcagcggcaccgatttcaccctgaccatcaatagcctggaagccgaggatgccgccacctactactgccagcagagcaaagaggtgcccttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcagctcttggatgaactgggtccgacaggcccctggcaaaggactggaatgggtcggaagaatctaccccggcgacggcgacaccaactacaacggcaagttcaagggcagattcaccatcagccgggacgacagcaagaacagcctgtacctgcagatgaactccctgaaaaccgaggacaccgccgtgtactactgtgccagatccggcttcatcaccaccgtgctggacttcgattattggggccagggcaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1601 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggccattcagctcacacagagcccttctagcctgagcgcctctgtgggcgacagagtgaccatcacatgtagagccagccagggcatcagcagcgcccagcagaaacctggaaaggcccctaagctgctgatcctggcctggtacagcagcctggaaagcggagtgcctagcagattcagcggctacgatgcctctggcagcggcaccgatttcaccctgacaatatccagcctccagcctgaggacttcgccacctactactgccagcagttcaacagctacccctacaccttcggccagggcaccaagctggaaatcaaaggcggaggcggaagtggaggcggaggatctggcggcggaggctctgaagtgcaactggttcagagcggagccgaagtgaagaagcctggcgagagcctgaagattagctgcaaaggctccggctacagcttcagcagctcttggatcggctgggtccgacagatgcctggcaaaggactggaatggatgggcatcatctaccccgacgacagcgacaccagatacagccctagcttccagggccaagtgacaatcagcgccgacaagagcatcagaaccgcctacctccagtggtcctctctgaaggccagcgataccgccatgtactactgcgccagacacgtgaccatgatctggggagtgattatcgacttctggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1602 - DNA, 3513 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1603 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggactacgacggcgacagctacctgaactggtatcagcagaagcccggccagcctcctaagctgctgatctacgatgccagcaacctggtgtctggcatccctcctagattttccggcagcggctctggcaccgatttcaccctgaccatcagcagactggaacccgaggacttcgccgtgtaccactgtcagcagagcacagaggacccctggacatttggcggaggcaccaagctggaaatcaaaggcggaggcggaagtggaggcggaggatctggcggcggaggctctcaggtgcagctggttgaatctggcggcggacttgttgagcctggcggatctctgagactgagctgcatgagcggctacgccttcagcagctactggatgaactgggtccgacagatgcccggcaaaggactggaatggatgggccagatttggcctggcgacggcgataccaactacaaccccagcctgaagtccagagtgaccatcaccgccgatgagagcaccagcaccgcctacatggaactgtctagcctgaaggccgaggatacagccgtgtacttctgcgccagacgggaaaccacaaccgtgggcagatattactacgctatggactactggggccagggcaccctggttacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1604 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggacaactacggcatcagcttcatgaactggtatcagcagaagcccggccagcctcctaagctgctgatctacgccgccagcaatcaaggctctggcatccccagcagattttccggctctggaagcggcaccgacttcaccctgaccataagcagcctggaacctgaggacttcgccatgtacttttgccagcagagcaacgaggtgcccagaacctttggcggaggcaccaagctggaaatcaaaggcggaggcggaagtggaggcggaggatctggcggcggaggctctcaggtgcaactggttgagtctggcggcggacttgttgaacctggcggaagcctgagactgagctgcatgagcggctacgcctttagcagctcctggatgaactgggtccgacagatgcctggcaaaggactggaatggatgggcagaatctaccccggcgacggcgacaccaactacaacggcaagttcaaagaacgggtcaccatcaccgccgacgagagcacaagcaccgcctacatggaactgagcagcctgaaggccgaggataccgccgtgtacttctgcgccagaagcgagtattggggcaactactgggctatggactactggggccagggcacactggtcacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1605 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacacagtctcccgccacactgtcactgtctccaggcgaaagagccacactgagctgcaaggccagtcagaacgtgggcacaaacgtggcctggtatcagcagaagcctggacagcctcctaagctgctgatctacagcgccacctaccggaactctggcatccctgccagattttctggcagcggctctggcaccgagttcaccctgaccatcaccaacgtgcagagcaaggacctggccgactacttctacttctgccagtacaacagatacccctacaccagcggcggaggcaccaagctggaaatcaaaagaggcggaggcggaagtggaggcggaggatctggcggcggaggctctcaggtgcaactggttgaatcaggcggaggactggtggaacctggcggatctctgagactgagctgtatgagcggctacgccttcagcagctactggatgaactgggtccgacagatgcccggcaaaggactggaatggatgggccaaatctaccccggcgacggcgacaccaactacaacggcaagttcaagggcagagtgacaatcaccgccgacgagagcacaagcaccgcctacatggaactgagcagcctgaaggccgaggataccgccgtgtacttctgcgccagaaagaccatcagcagcgtggtggatttctacttcgacaactggggccagggcaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1606 - DNA, 3486 bp, Artificial Sequence
  Synthetic Polynucleotide encoding a CAR with optional accessory module(s)
atggccttaccagtgaccgccttgctcctgccgctggccttgctgctccacgccgccaggccgatcaacatctacaacgccgagcctgccaatcctagcgagaagaacagccccgaattccagatcgtgctgacacagtctccagccacactgagcgcttctccaggcgagaaggccaccatgacatgttctgccagcagcggcgtgaactacatgcactggtatcagcagaagcccggcacaagccccaagcggtggatctacgataccgacaagacagccagcggagtgcccgccagattttctggctctggcagcggcacatcctacagcctgacaatcagcagcatggaagccgaggatgccgccacctactactgtcaccagagaggcagctacaccttcggcggaggcaccaagctggaaatcaaaggcggaggcggaagtggaggcggaggatctggcggcggaggctctcaagttcagctggaacaacctggcgctgaggtggtcaaaccaggggcctctgtgaaggtgtcctgcaagacaagcggctacacattcaccagcaactggatgcactgggtcaagcagacccctggcaaaggactggaatggatcggcgagatcgaccccagcgactcctacaccaactacaaccagaagttcgacggcaaggccaagctgaccgtggacaagtctagcagcaccgcctacatggaagtgtccgatctgaccgccgaagatagcgccacatattactgcgccagaggcagcaacccctactactacgctatggactattggggccagggcaccagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1607 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1608 - DNA, 3468 bp, Artificial Sequence
  Synthetic Polynucleotide encoding a CAR with optional accessory module(s)
atggccttaccagtgaccgccttgctcctgccgctggccttgctgctccacgccgccaggccggacgacatccagctgacccagagccccagcagcctgagcgccagcgtgggcgacagagtgaccatcacctgcaaggccagccagagcgtggactacgacggcgacagctacctgaactggtaccagcagatccccggcaaggcccccaagctgctgatctacgacgccagcaacctggtgagcggcatcccccccagattcagcggcagcggcagcggcaccgactacaccttcaccatcagcagcctgcagcccgaggacatcgccacctaccactgccagcagagcaccgaggacccctggaccttcggcggcggcaccaagctgcagatcaagagaggcggaggcggaagtggaggcggaggatctggcggcggaggctctcaggtgcagctgcagcagagcggcgccgaggtgaagaagcccggcagcagcgtgaaggtgagctgcaaggccagcggctacgccttcagcagctactggatgaactgggtgagacagagacccggccagggcctggagtggatcggccagatttggcccggcgacggcgacaccaactacaacggcaagttcaagggcagagccaccatcaccgccgacgagagcaccaacaccgcctacatggagctgagcagcctgagaagcgaggacaccgccttctacagctgcgccagaagagagaccaccaccgtgggcagatactactacgctatggactactggggccagggcaccaccgtgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1609 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1610 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1611 - DNA, 3474 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1612 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1613 - DNA, 3465 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1614 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1615 - DNA, 3459 bp, Artificial Sequence
  Synthetic Polynucleotide encoding a CAR with optional accessory module(s)
atgaggctccctgctcagctcctggggctgctaatgctctgggtctctggaagcagtggggatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaaggcggaggcggaagtggaggcggaggatctggcggcggaggctctgaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1616 - DNA, 3534 bp, Artificial Sequence
  Synthetic Polynucleotide encoding a CAR with optional accessory module(s)
atggccttaccagtgaccgccttgctcctgccgctggccttgctgctccacgccgccaggccggccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1617 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1618 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1619 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1620 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1621 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1622 - DNA, 3474 bp, Artificial Sequence
  Synthetic Polynucleotide encoding a CAR with optional accessory module(s)
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1623 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1624 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1625 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1626 - DNA, 3819 bp, Artificial Sequence
  Synthetic Polynucleotide encoding a CAR with optional accessory module(s)
atggttaggggcgttccattcagacatctgcttctggtcttgcagcttgcactcttgcccgctgccacccagggcaaaaaagtggtgctgggcaagaaaggcgacaccgtggaactgacctgcaccgccagccagaagaagtccatccagttccactggaagaacagcaaccagatcaagatcctgggcaaccagggcagcttcctgaccaagggacccagcaagctgaacgacagagccgacagcagacggtccctgtgggaccagggcaatttcccactgattatcaagaacctgaagatcgaggacagcgacacctacatctgcgaggtggaagatcagaaagaagaggtgcaactgctggtgttcggcctgaccgccaactccgacacccatctgctccagggccagagcctgaccctgacactggaaagccctccaggcagctcccccagcgtgcagtgtagaagcccacgaggcaagaacatccagggaggcaaaacattgtcagtgtcccaactggaactccaggactccggcacctggacctgtaccgtgctccagaaccagaaaaaggtggagttcaagatcgacatcgtggtgctggccttccagaaagcctctggcggaggcggaagtggaggcggaggatctggcggcggaggctctatctaccaggaactgacacaactgaaggccgccgtggaacggctgtgccacccttgtccttgggagtggaccttctttcagggcaactgctacttcatgagcaacagccagcggaactggcacgacagcatcaccgcctgcaaagaagtgggagcccaactggtcgtgattaagagcgccgaggaacagaacttcctccaactccagagcagcagaagcaacagattcacctggatgggcctgagcgacctgaaccaggaaggcacctggcagtgggtggacggatctcctctgctgcccagcttcaagcagtattggaaccggggcgagcccaacaacgtgggcgaagaggattgcgccgagttcagcggcaacggctggaacgacgacaagtgcaacctggctaagttctggatctgcaagaagtccgccgcctcctgtagccgggatgaggaacagttcctgagccctgcccctgccacccctaatcctccaccagctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1627 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1628 - DNA, 3447 bp, Artificial Sequence; identical to SEQ ID NO: 1627
  Synthetic Polynucleotide encoding a CAR with optional accessory module(s)

SEQ ID NO: 1629 - DNA, 3288 bp, Artificial Sequence
  Synthetic Polynucleotide encoding a CAR with optional accessory module(s)
atggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1630 - DNA, 3288 bp, Artificial Sequence
  Synthetic Polynucleotide encoding a CAR with optional accessory module(s)
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1631 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1632 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1633 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1634 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1635 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1636 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1637 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacatccagctcacacagagcccttctagcctgtctgccagcgtgggcgatagagtgaccatgacctgtagagccagcagcagcgtgtcctacatccactggttccagcagaagcctggcaaggcccctaagccttggatctacgccaccagcaatctggcctctggcgtgccagtcagattttctggcagcggctctggcaccgactacaccttcacaatatccagcctccagcctgaggacattgccacctactactgccagcagtggacctccaatcctcctacctttggcggaggcaccaagctggaaatcaaaggcggaggcggaagtggaggcggaggatctggcggcggaggctctcaggttcagctccagcagtctggggccgaagtgaagaaacctggcagctccgtgaaagtgtcctgcaaggccagcggctacacctttaccagctacaacatgcactgggtcaagcaggcccctggacagggactcgaatggatcggagccatctatcccggcaacggcgacacctcctacaaccagaagttcaagggcaaagccacactgaccgccgacgagagcacaaacaccgcctacatggaactgagcagcctgagaagcgaggacaccgccttctactactgtgcccggtctacctactacggcggcgactggtactttgacgtgtggggccagggaaccaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1638 - DNA, 3474 bp, Artificial Sequence
  Synthetic Polynucleotide encoding a CAR with optional accessory module(s)
atggccttaccagtgaccgccttgctcctgccgctggccttgctgctccacgccgccaggccgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1639 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1640 - DNA, 3444 bp, Artificial Sequence; identical to SEQ ID NO: 1636
  Synthetic Polynucleotide encoding a CAR with optional accessory module(s)

SEQ ID NO: 1641 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1642 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1643 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1644 - DNA, 3456 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1645 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1646 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1647 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1648 - DNA, 3429 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1649 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1650 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1651 - DNA, 3465 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1652 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1653 - DNA, 3531 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1654 - DNA, 3528 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1655 - DNA, 3576 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1656 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1657 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1658 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1659 - DNA, 3462 bp, Artificial Sequence
  Synthetic Polynucleotide encoding a CAR with optional accessory module(s)
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1660 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1661 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1662 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1663 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1664 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1665 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1666 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1667 - DNA, 3456 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1668 - DNA, 3456 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1669 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1670 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1671 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1672 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1673 - DNA, 3426 bp, Artificial Sequence
  Synthetic Polynucleotide encoding a CAR with optional accessory module(s)
atggccttaccagtgaccgccttgctcctgccgctggccttgctgctccacgccgccaggccggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1674 - DNA, 3519 bp, Artificial Sequence
  Synthetic Polynucleotide encoding a CAR with optional accessory module(s)
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1675 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1676 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1677 - DNA, 3471 bp, Artificial Sequence
  Synthetic Polynucleotide encoding a CAR with optional accessory module(s)
atggccttaccagtgaccgccttgctcctgccgctggccttgctgctccacgccgccaggccggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1678 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1679 - DNA, 3429 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1680 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1681 - DNA, 3423 bp, Artificial Sequence
  Synthetic Polynucleotide encoding a CAR with optional accessory module(s)
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1682 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1683 - DNA, 3429 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1684 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1685 - DNA, 3468 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1686 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1687 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1688 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1689 - DNA, 3429 bp, Artificial Sequence
  Synthetic Polynucleotide encoding a CAR with optional accessory module(s)
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1690 - DNA, 3465 bp, Artificial Sequence
  Synthetic Polynucleotide encoding a CAR with optional accessory module(s)
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1691 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1692 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1693 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1694 - DNA, 3456 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1695 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1696 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1697 - DNA, 3486 bp, Artificial Sequence
  Synthetic Polynucleotide encoding a CAR with optional accessory module(s)
atggccttaccagtgaccgccttgctcctgccgctggccttgctgctccacgccgccaggccggacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctggcggaggcggaagtggaggcggaggatctggcggcggaggctctcaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1698 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1699 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1700 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1701 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1702 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1703 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1704 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1705 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1706 - DNA, 3441 bp, Artificial Sequence
  Synthetic Polynucleotide encoding a CAR with optional accessory module(s)
atggccttaccagtgaccgccttgctcctgccgctggccttgctgctccacgccgccaggccggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1707 - DNA, 3456 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1708 - DNA, 3456 bp, Artificial Sequence
  Synthetic Polynucleotide encoding a CAR with optional accessory module(s)
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1709 - DNA, 3489 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgagggcggaggcggaagtggaggcggaggatctggcggcggaggctctttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1710 - DNA, 3591 bp, Artificial Sequence
  Synthetic Polynucleotide encoding a CAR with optional accessory module(s)
atggccttaccagtgaccgccttgctcctgccgctggccttgctgctccacgccgccaggccggacgaattcgaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagtctcgagggaggaggcggctccgggggaggcggaagtggaggcggaggatctgggtctggaggaagcggatctggaggctcagggtcagggggctcaggcagtggaggctctttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1711 - DNA, 3450 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1712 - DNA, 3435 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1713 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacagcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccggcggaggcggaagtggaggcggaggatctggcggcggaggctctgaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1714 - DNA, 3447 bp, Artificial Sequence
  Synthetic Polynucleotide encoding a CAR with optional accessory module(s)
atggccttaccagtgaccgccttgctcctgccgctggccttgctgctccacgccgccaggccggaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgggcggaggcggaagtggaggcggaggatctggcggcggaggctctgacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1715 - DNA, 3093 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1716 - DNA, 3519 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagggcggaggcggaagtggaggcggaggatctggcggcggaggctctttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1717 - DNA, 3576 bp, Artificial Sequence
  Synthetic Polynucleotide encoding a CAR with optional accessory module(s)
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagggaggaggcggctccgggggaggcggaagtggaggcggaggatctgggtctggaggaagcggatctggaggctcagggtcagggggctcaggcagtggaggctctttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1718 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1719 - DNA, 3438 bp, Artificial Sequence
  Synthetic Polynucleotide encoding a CAR with optional accessory module(s)
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1720 - DNA, 3459 bp, Artificial Sequence
  Synthetic Polynucleotide encoding a CAR with optional accessory module(s)
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1721 - DNA, 3462 bp, Artificial Sequence
  Synthetic Polynucleotide encoding a CAR with optional accessory module(s)
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1722 - DNA, 3453 bp, Artificial Sequence
  Synthetic Polynucleotide encoding a CAR with optional accessory module(s)
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1723 - DNA, 3444 bp, Artificial Sequence
  Synthetic Polynucleotide encoding a CAR with optional accessory module(s)
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

(The sequence listing continues in the following parts.)

What is claimed is:

1. A T cell or T cell population with impaired or abolished functional expression of an endogenously expressed TCR chain and expressing at least one non-naturally occurring immune receptor from an expression cassette placed in an endogenous TCR gene locus; wherein the endogenous TCR gene locus is a TCRα chain locus;

wherein the at least one non-naturally occurring immune receptor comprises two TCR constant chains or functional fragments or variants thereof;

and wherein the at least one non-naturally occurring immune receptor comprises one or more non-naturally occurring TCR antigen binding domains selected from the group consisting of i) a heavy chain variable region of an antibody (vH domain) and a complementary light chain variable region of the antibody (vL domain), (ii) a single chain variable fragment (scFv), (iii) a single domain antibody (SDAB), (iv) a camelid vHH domain, and (vi) a ligand.

2. The T cell or T cell population of claim 1, wherein the at least one non-naturally occurring immune receptor is capable of recruiting at least one TCR associated signaling module.

3. The T cell or T cell population of claim 1, where the at least one non-naturally occurring immune receptor is under the control of a promoter and/or regulatory elements for an endogenous TCRα chain.

4. The T cell or T cell population of claim 1, wherein the placement of the non-naturally occurring immune receptor expression cassette disrupts or abolishes the endogenous expression of a TCR comprising an endogenous TCRα chain and an endogenous TCRβ chain.

5. The T cell or T cell population of claim 1, wherein the disruption or abolished expression of an endogenous TCR chain results in enhanced expression and/or activity of the at least one non-naturally occurring immune receptor as compared to its expression and/or activity in T cells with wild-type endogenous TCR.

6. The T cell or T cell population of claim 5, wherein the at least one non-naturally occurring immune receptor is an abTCR.

7. The T cell or T cell population of claim 1, wherein the T cell further lacks the expression of a functional HLA and is not alloreactive.

8. The T cell or T cell population of claim 1, wherein the at least one non-naturally occurring immune receptor binds to an antigen selected from a group consisting of CD5; CD19; CD123; CD22; CD30; CD171; CS1 (also referred to as CD2 subset 1, CRACC, MPL, SLAMF7, CD319, and 19A24); C-type lectin-like molecule-1 (CLL-1 or CLECL1); CD33; epidermal growth factor receptor variant III (EG-FRviii); ganglioside G2 (GD2); ganglioside GD3 (aNeu5Ac (2-8)aNeu5Ac(2-3)bDGalp(1-4)bDGlcp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-llRa); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); sialyl Lewis adhesion molecule (sLe); ganglioside GM3 (aNeu5Ac(2-3) bDClalp(1-4)bDGlcp(1-1)Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-la); Melanoma-associated antigen 1 (MAGE-A1); ETS translocation-variant gene 6, located on chromosome 12p (ETV6-AML); sperm protein 17 (SPA17); X Antigen Family, Member IA (XAGE1);

angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; survivin; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYPIB 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TESI); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RUI); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GM1, PTK7, gpNMB, CDH1-CD324, DLL3, CD276/B7H3, IL11Ra, IL13Ra2, CD179b-IGL11, TCR gamma-delta, NKG2D, CD32 (FCGR2A), Tn ag, Tim1–/HVCR1, CSF2RA (GM-CSFR-alpha), TGF-betaR2, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Gonadotropin Hormone receptor (CGHR or GR), CCR4, GD3, SLAMF6, SLAMF4, HIV1 envelope glycoprotein, HTLV1-Tax, CMV pp65, EBV-EBNA3c, KSHV K8.1, KSHV-gH, influenza A hemagglutinin (HA), GAD, PDL1, Guanylyl cyclase C (GCC), auto antibody to desmoglein 3 (Dsg3), auto antibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IgE, CD99, Ras G12V, Tissue Factor 1 (TF1), AFP, GPRC5D, Claudin18.2 (CLD18A2 or CLDN18A.2), P-glycoprotein, STEAP1, Liv1, Nectin-4, Cripto, gpA33, BST1/CD157, low conductance chloride channel, and an antigen recognized by TNT antibody.

9. The T cell of claim 1, where the T cell is an autologous T cell, an allogeneic T cell, an induced pluripotent stem cell derived T cell, a stem cell derived T cell, a cytotoxic T lymphocyte (CTL), regulatory T cell, immunoinhibitory T cell, CD4+ T cell, CD8+ cell, central memory T cell (TCM), stem memory T cell (TSCM), effector memory T cell, effector T cell, Th1 cell, Th2 cell, Th9 cell, Th17 cell, Th22 cell, or T fh (follicular helper) cell.

10. A pharmaceutical composition comprising a therapeutically effective amount of the T cell of claim 1; and a pharmaceutically acceptable carrier.

11. The T cell or T cell population of claim 1, wherein the at least one non-naturally occurring immune receptor comprises two TCR constant chains that form a dimer or a multimer with an endogenous TCR chain and CD3γ, CD3δ and CD3ε chains.

12. The T cell or T cell population of claim 1, wherein the at least one non-naturally occurring immune receptor comprises one or more non-naturally occurring TCR antigen binding domains selected from the group consisting of
   (i) a heavy chain variable region of an antibody (vH domain) and a complementary light chain variable region of the antibody (vL domain),
   (ii) a single chain variable fragment (scFv),
   (iii) a single domain antibody (SDAB),
   (iv) a camelid vHH domain, and/or
   (v) a ligand, and
   operatively linked to:
   a) two exogenously expressed TCR constant chains selected from the group consisting of constant chain of TCRα (or Cα), TCRβ1 (or Cβ1), TCRβ2 (or Cβ2), TCRγ (or Cγ) and TCRδ (or Cδ) and a functional fragment or a variant thereof, and wherein the two exogenously expressed TCR constant chains or the functional fragment or the variant thereof are expressed from the expression cassette placed in the endogenous TCR gene locus; or
   b) two exogenously expressed TCR constant chains chain selected from the group consisting of constant chain of TCRα (or Cα), TCRβ1 (or Cβ1), TCRβ2 (or Cβ2), TCRγ (or Cγ) and TCRδ (or Cδ) and a functional fragment or variant thereof; or
   c) one exogenously expressed TCR constant chains selected from the group consisting of constant chain of TCRβ1 (or Cβ1), TCRβ2 (or Cβ2), and a functional fragment or a variant thereof and one endogenously expressed TCR α (or Cα) constant chain, and wherein the one exogenously expressed TCR constant chain or the functional fragment or the variant thereof is expressed from the expression cassette placed in the endogenous TCR gene locus.

13. The T cell or T cell population of claim 1, wherein the endogenous TCR gene locus is a first endogenous TCR locus, and a second endogenous TCR locus that is different from the first endogenous TCR locus is modified to eliminate the expression of an endogenous TCR chain encoded by the second endogenous TCR locus.

14. The T cell or T cell population of claim 1, where the at least one non-naturally occurring immune receptor comprises two TCR constant chains selected from the group consisting of:
   (i) a T cell receptor alpha (TCRα) constant chain (Cα) having an amino acid sequence selected from the group consisting of SEQ ID NOS: 15041-15048 and 15133, and a functional fragment or variant thereof, an amino acid sequence with at least 85% identity to any one of SEQ ID NOS: 15041-15048 and 15133, and a sequence that is at least 85% identical to SEQ ID NO: 15041 and comprises one or more of the mutations at the following position-amino acids 10C, 15C, 45C, 48C, 61R, 91S, 92D, 93V, and/or 94P, and the equivalent residues from a non-human species;

(ii) a T cell receptor beta (TCRβ) constant chain (Cβ) having an amino acid sequence selected from the group consisting of SEQ ID NOS: 15051-15056, 15068 and 15134 and a functional fragment or variant thereof, an amino acid sequence with at least 85% identity to any one of SEQ ID NOS: 15051-15056, 15068 and 15134, and an amino acid sequence that is at least 85% identical to SEQ ID NO: 15051 or 15052 and comprises one or more of the mutations at the following position-amino acids 15C, 17C, 18K or R, 22A, 57C, 59C, 77C, 79G, 133I, 136A and/or 139H, and the equivalent residues from a non-human species;

(iii) a T cell receptor gamma (TCRγ) constant chain (Cγ) having an amino acid sequence selected from the group consisting of SEQ ID NOS: 15068 and 15135, a functional fragment or variant thereof, and an amino acid sequence having at least 85% identity to SEQ ID NO: 15068 or 15135, and the equivalent residues from a non-human species; and (iv) a T cell receptor delta (TCRδ) constant chain (Cδ) having an amino acid sequence selected from the group consisting of SEQ ID NOS: 15069 and 15136, a functional fragment or variant thereof, and an amino acid sequence having at least 85% identity to SEQ ID NO: 15069 or 15136, and the equivalent residues from a non-human species.

15. The T cell or T cell population of claim 1, wherein the at least one non-naturally occurring immune receptor comprises TCR constant chains comprising one or more mutations that a) enhance the expression of the at least one non-naturally occurring immune receptor; and/or enhance the pairing of the two TCR constant chains or b) reduce the pairing of the two TCR constant chains with an endogenous TCR chain; and/or c) results in formation of an extra disulfide bond between the two TCR constant chains, as compared to wild-type TCR constant chains.

16. The T cell or T cell population of claim 1, wherein the at least one non-naturally occurring immune receptor comprises:

a) the heavy chain variable region of an antibody (vH domain) and the complementary light chain variable region of the antibody (vL domain), such that, when expressed, one of said vH domain and vL domain of the antibody is attached to a first off said two TCR constant chains or functional fragments or variants thereof and the other of said vH domain and vL domain of the antibody is attached to a second of the said two TCR constant chains or functional fragments or variants thereof; or b) an scFv specific for a predefined target antigen attached to one of the two TCR constant chains or functional fragments or variants thereof; or c) one or two single domain antibody (SDAB) specific for one or two predefined target antigens, such that, when expressed, one of said two SDAB is attached to a first one of said two TCR constant chains or functional fragments or variants thereof and the other of said SDAB is attached to a second of said two TCR constant chains or functional fragments or variants thereof; or d) one or two camelid vHH domains specific for one or two predefined target antigens, such that, when expressed, one of said two vHH domains is attached to a first of said two TCR constant chains or functional fragments or variants thereof and the other of said two vHH domains is attached to a second of said two TCR constant chains or functional fragments or variants thereof.

17. The T cell or T cell population of claim 1, wherein the at least one non-naturally occurring immune receptor comprises two antigen binding chains comprising:

i) a first antigen-binding chain comprising a heavy chain variable region of an antibody (vH domain); and ii) a second antigen-binding chain comprising a light chain variable region of the antibody (vL domain);

wherein the first and second antigen-binding chains each comprise a TCRα constant chain (TRAC) polypeptide or a TCRβ constant chain (TRBC) polypeptide, wherein at least one of the TRAC polypeptide and the TRBC polypeptide is endogenous, and the first and the second antigen-binding chains together bind to an antigen.

18. The T cell or T cell population of claim 17, wherein (a) the first antigen-binding chain comprises a vH domain of an antibody and an endogenous TRAC polypeptide, and the second antigen-binding chain comprising a vL domain of the antibody and an exogenous TRBC polypeptide, or (b) the first antigen-binding chain comprises a vL domain of an antibody and an endogenous TRAC polypeptide; and the second antigen-binding chain comprising a vH domain of the antibody and an exogenous TRBC.

19. The T cell or T cell population of claim 1, wherein a promotor-less recombinant nucleic acid sequence encoding the at least one non-naturally occurring immune receptor is integrated at a site in the genome of the cell, said site being the first exon of a TCR alpha chain, such that the at least one non-naturally occurring immune receptor is expressed under control of an endogenous TCR alpha chain promoter, to produce said at least one non-naturally occurring immune receptor at the surface of the cell, and wherein integration of the at least one non-naturally occurring immune receptor at said site reduces or prevents expression of a functional TCR alpha chain.

20. A T cell or a T cell population with impaired or abolished functional expression of an endogenously expressed TCR chain and expressing at least one non-naturally occurring immune receptor from an expression cassette placed in an endogenous TCR alpha chain gene locus;

wherein the at least one non-naturally occurring immune receptor comprises two TCR constant chains or functional fragments or variants thereof; and wherein the at least one non-naturally occurring immune receptor comprises the variable regions of heavy and light chains of an antibody specific for a predefined target antigen such that when expressed, one of said heavy and light chain variable regions of the antibody is attached to one of said two TCR constant chains or functional fragments or variants thereof either directly or via a linker and the other of said heavy and light chain variable regions of the antibody is attached to the other of said two TCR constant chains or functional fragments or variants thereof either directly or via a linker.

21. The T cell or T cell population of claim 12, wherein the one or more non-naturally occurring TCR antigen binding domains are operably linked to TCR constant chains of 91(a) and 91(b) via one or more linker domains.

* * * * *